US009249415B2

(12) United States Patent
Fitzgerald et al.

(10) Patent No.: US 9,249,415 B2
(45) Date of Patent: Feb. 2, 2016

(54) COMPLEMENT COMPONENT C5 IRNA COMPOSITIONS AND METHODS OF USE THEREOF

(71) Applicant: Alnylam Pharmaceuticals, Inc., Cambridge, MA (US)

(72) Inventors: Kevin Fitzgerald, Brookline, MA (US); James Butler, Lynnfield, MA (US); Brian Bettencourt, Groton, MA (US); Anna Borodovsky, Melrose, MA (US); Satyanarayana Kuchimanchi, Acton, MA (US); Klaus Charisse, Acton, MA (US); Muthiah Manoharan, Weston, MA (US); Martin Maier, Belmont, MA (US); Kallanthottathil G. Rajeev, Wayland, MA (US); Donald Foster, Attleboro, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 14/699,140

(22) Filed: Apr. 29, 2015

(65) Prior Publication Data
US 2015/0247143 A1    Sep. 3, 2015

Related U.S. Application Data

(63) Continuation of application No. PCT/US2014/025882, filed on Mar. 13, 2014.

(60) Provisional application No. 61/942,367, filed on Feb. 20, 2014, provisional application No. 61/912,777, filed on Dec. 6, 2013, provisional application No. 61/904,579, filed on Nov. 15, 2013, provisional application No. 61/837,399, filed on Jun. 20, 2013, provisional application No. 61/782,531, filed on Mar. 14, 2013.

(51) Int. Cl.
*C12N 15/113* (2010.01)

(52) U.S. Cl.
CPC .......... *C12N 15/113* (2013.01); *C12N 2310/14* (2013.01); *C12N 2310/315* (2013.01); *C12N 2310/321* (2013.01); *C12N 2310/351* (2013.01); *C12N 2310/3527* (2013.01)

(58) Field of Classification Search
USPC ......................... 514/44; 536/23.1, 24.5, 24.33
See application file for complete search history.

(56) References Cited

FOREIGN PATENT DOCUMENTS

| EP | 1752536 A1 | 2/2007 |
|---|---|---|
| WO | WO-2004/045543 A2 | 6/2004 |
| WO | WO-2009/073809 A2 | 6/2009 |
| WO | WO-2009/108931 A2 | 9/2009 |
| WO | WO-2010/048352 A2 | 4/2010 |

OTHER PUBLICATIONS

Cheng Ling-Li et al: "Effect of C5-siRNA silencing receptor C5 on myocardial ischemia injury in rats", Journal of Southern Medical University, vol. 38, No. 6, May 19, 2010.
Database EMBL, Aug. 18, 2010, "Sequence 43781 from Patent EP2213738", XP882729257, retrieved from EBI accession No. EM PAT:HD166985.
Database EMBL, Aug. 26, 2010, "Sequence 935538 from Patent EP2213738.", XP882729258, retrieved from EBI accession No. EM PAT:HH858823.
International Search Report from PCT/US2014/025882 dated Oct. 14, 2014.

*Primary Examiner* — Terra C Gibbs
(74) *Attorney, Agent, or Firm* — McCarter & English, LLP; Maria Laccotripe Zacharakis; Deborah L. Nagle

(57) ABSTRACT

The invention relates to iRNA, e.g., double-stranded ribonucleic acid (dsRNA), compositions targeting the complement component C5 gene, and methods of using such iRNA, e.g., dsRNA, compositions to inhibit expression of C5 and to treat subjects having a complement component C5-associated disease, e.g., paroxysmal nocturnal hemoglobinuria.

30 Claims, 25 Drawing Sheets

```
SEQ ID NO:1
>gi|38016946|ref|NM_001735.2| Homo sapiens complement component 5 (C5),
mRNATATATCCGTGGTTTCCTGCTACCTCCAACCATGGGCCTTTTGGGAATACTTTGTTTTTTAATCTTCCTGGGGAAAACCTGGGGACAGGAGC
AAACATATGTCATTTCAGCACCAAAAATATTCCGTGTTGGAGCATCTGAAAATATTGTGATTCAAGTTTATGGATACACTGAAGCATTTGATGCA
ACAATCTCTATTAAAAGTTATCCTGATAAAAAATTTAGTTACTCCTCAGGCCATGTTCATTTATCCTCAGAGAATAAATTCCAAAACTCTGCAAT
CTTAACAATACAACCAAAACAATTGCCTGGAGGACAAAACCCAGTTTCTTATGTGTATTTGGAAGTTGTATCAAAGCATTTTTCAAAATCAAAAA
GAATGCCAATAACCTATGACAATGGATTTCTCTTCATTCATACAGACAAACCTGTTTATACTCCAGACCAGTCAGTAAAAGTTAGAGTTTATTCG
TTGAATGACGACTTGAAGCCAGCCAAAAGAGAAACTGTCTTAACTTTCATAGATCCTGAAGGATCAGAAGTTGACATGGTAGAAGAAATTGATCA
TATTGGAATTATCTCTTTTCCTGACTTCAAGATTCCGTCTAATCCTAGATATGGTATGTGGACGATCAAGGCTAAATATAAAGAGGACTTTTCAA
CAACTGGAACCGCATATTTTGAAGTTAAAGAATATGTCTTGCCACATTTTTCTGTCTCAATCGAGCCAGAATATAATTTCATTGGTTACAAGAAC
TTTAAGAATTTTGAAATTACTATAAAAGCAAGATATTTTTATAATAAAGTAGTCACTGAGGCTGACGTTTATATCACATTTGGAATAAGAGAAGA
CTTAAAAGATGATCAAAAAGAAATGATGCAAACAGCAATGCAAAACACAATGTTGATAAATGGAATTGCTCAAGTCACATTTGATTCTGAAACAG
CAGTCAAAGAACTGTCATACTACAGTTTAGAAGATTTAAACAACAAGTACCTTTATATTGCTGTAACAGTCATAGAGTCTACAGGTGGATTTTCT
GAAGAGGCAGAAATACCTGGCATCAAATATGTCCTCTCTCCCTACAAACTGAATTTGGTTGCTACTCCTCTTTTCCTGAAGCCTGGGATTCCATA
TCCCATCAAGGTGCAGGTTAAAGATTCGCTTGACCAGTTGGTAGGAGGAGTCCCAGTAACACTGAATGCACAAACAATTGATGTAAACCAAGAGA
CATCTGACTTGGATCCAAGCAAAAGTGTAACACGTGTTGATGATGCAGTAGCTTCCTTTGTGCTTAATCTCCCATCTGGAGTGACGGTGCTGGAG
TTTAATGTCAAAACTGATGCTCCAGATCTTCCAGAAGAAAATCAGGCCAGGGAAGGTTACCGAGCAATAGCATACTCATCTCTCAGCCAAAGTTA
CCTTTATATTGATTGGACTGATAACCATAAGGCTTTGCTAGTGGGAGAACATCTGAATATTATTGTTACCCCCAAAAGCCCATATATTGACAAAA
TAACTCACTATAATTACTTGATTTTATCCAAGGGCAAAATTATCCACTTTGGCACGAGGGAGAAATTTTCAGATGCATCTTATCAAAGTATAAAC
ATTCCAGTAACACAGAACATGGTTCCTTCATCCCGACTTCTGGTCTATTACATCGTCACAGGAGAACAGACAGCAGAATTAGTGTCTGATTCAGT
CTGGTTAAATATTGAAGAAAAATGTGGCAACCAGCTCCAGGTTCATCTGTCTCCTGATGCAGATGCATATTCTCCAGGCCAAACTGTGTCTCTTA
ATATGGCAACTGGAATGGATTCCTGGGTGGCATTAGCAGCAGTGGACAGTGCTGTGTATGGAGTCCAAAGAGGAGCCAAAAAGCCCTTGGAAAGA
GTATTTCAATTCTTAGAGAAGAGTGATCTGGGCTGTGGGGCAGGTGGTGGCCTCAACAATGCCAATGTGTTCCACCTAGCTGGACTTACCTTCCT
CACTAATGCAAATGCAGATGACTCCCAAGAAAATGATGAACCTTGTAAAGAAATTCTCAGGCCAAGAAGAACGCTGCAAAAGAAGATAGAAGAAA
TAGCTGCTAAATATAAACATTCAGTAGTGAAGAAATGTTGTTACGATGGAGCCTGCGTTAATAATGATGAAACCTGTGAGCAGCGAGCTGCACGG
ATTAGTTTAGGGCCAAGATGCATCAAAGCTTTCACTGAATGTTGTGTCGTCGCAAGCCAGCTCCGTGCTAATATCTCTCATAAAGACATGCAATT
GGGAAGGCTACACATGAAGACCCTGTTACCAGTAAGCAAGCCAGAAATTCGGAGTTATTTTCCAGAAAGCTGGTTGTGGGAAGTTCATCTTGTTC
CCAGAAGAAAACAGTTGCAGTTTGCCCTACCTGATTCTCTAACCACCTGGGAAATTCAAGGCGTTGGCATTTCAAACACTGGTATATGTGTTGCT
GATACTGTCAAGGCAAAGGTGTTCAAAGATGTCTTCCTGGAAATGAATATACCATATTCTGTTGTACGAGGAGAACAGATCCAATTGAAAGGAAC
TGTTTACAACTATAGGACTTCTGGGATGCAGTTCTGTGTTAAAATGTCTGCTGTGGAGGGAATCTGCACTTCGGAAAGCCCAGTCATTGATCATC
AGGGCACAAAGTCCTCCAAATGTGTGCGCCAGAAAGTAGAGGGCTCCTCCAGTCACTTGGTGACATTCACTGTGCTTCCTCTGGAAATTGGCCTT
CACAACATCAATTTTTCACTGGAGACTTGGTTTGGAAAAGAAATCTTAGTAAAAACATTACGAGTGGTGCCAGAAGGTGTCAAAAGGGAAAGCTA
TTCTGGTGTTACTTGGATCCTAGGGGTATTTATGGTACCATTAGCAGACAGAAGGAGTTCCCATACAGGATACCCTTAGATTTGGTCCCCAAAA
CAGAAATCAAAAGGATTTTGAGTGTAAAAGGACTGCTTGTAGGTGAGATCTTGTCTGCAGTTCTAAGTCAGGAAGGCATCAATATCCTAACCCAC
CTCCCCAAAGGGAGTGCAGAGGCGGAGCTGATGAGCGTTGTCCCAGTATTCTATGTTTTTCACTACCTGGAAACAGGAAATCATTGGAACATTTT
TCATTCTGACCCATTAATTGAAAAGCAGAAACTGAAGAAAAAATTAAAAGAAGGGATGTTGAGCATTATGTCCTACAGAAATGCTGACTACTCTT
ACAGTGTGTGGAAGGGTGGAAGTGCTAGCACTTGGTTAACAGCTTTTGCTTTAAGAGTACTTGGACAAGTAAATAAATACGTAGAGCAGAACCAA
AATTCAATTTGTAATTCTTTATTGTGGCTAGTTGAGAATTATCAATTAGATAATGGATCTTTCAAGGAAAATTCACAGTATCAACCAATAAAATT
ACAGGGTACCTTGCCTGTTGAAGCCCGACAGAACAAGAATTTCCTTGGGAGCCAGTAGAGGTGCTTCTCAATGATGACCTCATTGTCAGTACAG
TGGTGAAAATCGACACAGCTCTAATTAAAGCTGACAACTTCTGCTTGAAAATACACTGCCAGCCCAGAGCACCTTTACATTGGCCATTTCTGCG
TATGCTCTTTCCCTGGGAGATAAAACTCACCCACAGTTTCGTTCAATTGTTTCAGCTTTGAAGAGAGAAGCTTTGGTTAAAGGTAATCCACCCAT
TTATCGTTTTTGGAAAGACAATCTTCAGCATAAAGACAGCTCTGTACCTAACACTGGTACGGCACGTATGGTAGAAACAACTGCCTATGCTTTAC
TCACCAGTCTGAACTTGAAAGATATAAATTATGTTAACCCAGTCATCAAATGGCTATCAGAAGAGCAGAGGTATGGAGGTGGCTTTTATTCAACC
CAGGACACAATCAATGCCATTGAGGGCCTGACGGAATATTCACTCCTGGTTAAACAACTCCGCTTGAGTATGGACATCGATGTTTCTTACAAGCA
TAAAGGTGCCTTACATAATTATAAAATGACAGACAAGAATTTCCTTGGAGGCCAGTAGAGGTGCTTCTCAATGATGACCTCATTGTCAGTACAG
GATTTGGCAGTGGCTTGGCTACAGTACATGTAACAACTGTAGTTCACAAAACCAGTACCTCTGAGGAAGTTTGCAGCTTTTATTTCAAAATCGAT
ACTCAGGATATTGAAGCATCCCACTACAGAGGCTACGGAAACTCTGATTACAAACGCATAGTAGCATGTGCCAGCTACAAGCCCAGCAGGGAAGA
ATCATCATCTGGATCCTCTCATGCGGTGATGGACATCTCCTTGCCTACTGGAATCAGTGCAAATGAAGAAGACTTAAAAGCCCTTGTGGAAGGGG
TGGATCAACTATTCACTGATTACCAAATCAAAGATGGACATGTTATTCTGCAACTGAATTCGATTCCCTCCAGTGATTTCCTTTGTGTACGATTC
CGGATATTTGAACTCTTTGAAGTTGGGTTTCTCAGTCCTGCCACTTTCACAGTGTACGAATACCACAGACCAGATAAACAGTGTACCATGTTTTA
TAGCACTTCCAATATCCAAAATTCAGAAAGTCTGTGAAGGAGCCGCGTGTAGAAGCTGATTGTGGGCAAATGCAGGAAGAATTGGATC
TGACAATCTCTGCAGAGACAAGAAAACAAACAGCATGTAAAACCAGAGATTGCATATGCTTATAAAGTTAGCATCACATCCATCACTGTAGAAAT
GTTTTTGTCAAGTACAAGGCAACCCTTCTGGATATCTACAAAACTGGGGAAGCTGTTGCTGAGAAAGACTCTGAGATTACCTCATTAAAAAGGT
AAACCTGTACTAACGCTGAGCTGGTAAAAGGAAGACAGTACTTAATTATGGGTAAAGAAGCCCTCCAGATAAAATACAATTTCAGTTTCAGGTACA
TCTACCCTTTAGATTCCTTGACCTGGATTGAATACTGGCCTAGAGACACAACATGTTCATCGTGTCAAGCATTTTTAGCTAATTTAGATGAATTT
GCCGAAGATATCCTTTTAAATGGATGCTAAAATTCCTGAAGTTCAGCTGCATACAGTTTGCACTTATGGACTCCTGTTGTTGAAGTTCGTTTTTT
TGTTTTCTTCTTTTTTTAAACATTCATAGCTGGTCTTATTTGTAAAGCTCACTTTACTTAGAATTAGTGGCACTTGCTTTATTAGAGAATGATT
TCAAATGCTGTAACTTTCTGAAATAACATGGCCTTGGAGGGCATGAAGACAGATACTCCTCCAAGGTTATTGGACACCGGAAACAATAAATTGGA
ACACCTCCTCAAACCTACCACTCAGGAATGTTGCTGGGGCCGAAAGAACAGTCCATTGAAAGGGAGTATTACAAAAACATGGCCTTTGCTTGAA
AGAAAATACCAAGGAACAGGAAACTGATCATTAAAGCCTGAGTTTGCTTTCAAAAAAAAAAAAAAAAAAA
```

Figure 18A

SEQ ID NO:2
>gi|297270252|ref|XM_001095750.2| PREDICTED: Macaca mulatta complement component 5 (C5), mRNA
CATGATTTCCTGCTACCTCCAACCATGGGCCTTTTGGGAATACTTTGTTTTTTAATCTTCCTGGGAAAAACTTGGGGACAGGGAGCAAACATATGTCATT
TCAGCACCAAAAATATTCCGTGTTGGAGCATCTGAAAACATTGTGATTCAAGTTTATGGATACACTGAAGCATTTGATGCAACAATCTCTATTAAAAG
TTATCCTGATAAAAAATTTAGTTACTCCTCAGGCCATGTTCATTTATCCTCAGAGAATAAATTCCAAAACTCGGCAGTCTTAACAATACAACCAAAACA
ATTACCTGGAGGACAAAACCAAGTTTCTTATGTGTATTTGGAAGTTGTATCAAAGCATTTTTCAAAATCAAAAAAATTCCAATAACCTATGACAATG
GATTTCTCTTCATTCATACAGACAAACCTGTTATACTCCAGACCAATCAGTAAAGGTTAGAGTTTATTCGTTGAATGATGACTTGAAGCCAGCCAAAA
GAGAAACTGTCTTAACTTTCATAGATCCTGAAGGATCAGAAATTGACATGGTAGAAGAAATTGATCATATTGGAATTATCTCTTTTCCTGACTTCAAG
ATTCCGTCTAATCCTAGATATGGTATGTGGATGATCCAGGCTAAATATAAAGAGGACTTTTCAACAACTGGAACTGCATTTTTTGAAGTTAAAGAATA
TGTCTTGCCACATTTTTCTGTCTCAGTAGAACCAGAAAGTAAATTCATTGGTTATAAGAACTTTAAGAATTTTGAAATTACTATAAAAGCAAGATATTT
TTATAATAAAGTAGTCACTGAGGCTGATGTTTATATCACATTTGGAATAAGAGAAGACTTAAAAGATGATCAAAAAGAAATGATGCAAACAGCAATG
CAAAACACAATGTTGATAAATGGAATTGCTCAAGTCACATTTGATTCTGAAACAGCAGTCAAAGAACTGTCATACTACAGTTTAGAAGATTTAAACAA
CAAGTACCTTTATATTGCTGTAACAGTCATAGAGTCTACAGGTGGATTTTCTGAAGAGGCAGAAATACCTGGCATCAAATATGTCCTCTCTCCCTACA
AACTGAATTTGGTTGCTACTCCTCTTTTCCTGAAGCCTGGGATTCCATATTCCATCAAGGTGCAGGTTAAAGATGCGCTTGACCAGTTGGTAGGAGGG
GTCCCAGTAACACTGAATGCACAAACAATTGATGTCAACCAAGGAGACATCTGACTTGGAGCCAAGGAAAAGTGTAACACGTGTTGATGATGGAGTA
GCTTCGTTTGTGGTTAATCTCCCATCTGGAGTGACGGTGCTGGAGTTTAATGTCAAAACTGATGCTCCAGATCTTCCAGACGAAAATCAGGCCAGGG
AAGGTTACCGAGCAATAGCATACTCATCTCTCAGCCAAAGTTACCTTTATATCGATTGGACTGATAACCACAAGGCTTTGCTAGTGGGAGAATATTTG
AATATTATTGTTACCCCCAAAAGCCCATATATTGACAAAATAACTCACTATAATTACTTGATTTTATCCAAGGGCAAAATTATCCACTTTGGCACAAGG
GAGAAACTTTCAGATGCATCTTATCAAAGTATAAACATTCCAGTAACGCAGAACATGGTTCCTTCATCCCGACTCCTGGTCTATTACATCGTCACAGG
AGAGCAGACAGCAGAATTAGTGTCTGATTCAGTCTGGTTAAATATTGAAGAAAAATGTGGCAACCAGCTCCAGGTTCATCTGTCTCCTGATGCAGAT
ACATATTCTCCAGGCCAAACTGTGTCTCTTAATATGGTAACTGGGATGGATTCCTGGGTGGCATTAACAGCAGTGGACAGCGCTGTGTATGGAAGTCC
AAATGAAGAGCCAAAAAAGCCCTTGGAAAGAGTATTTCAATTCTTAAGAGAAGGTGATCTGGGCTGTGGGGCAGGTGGTGGCCTCAACAATGCCAATG
TGTTCCACCTAGCTGGACTTACCTTCCTCACTAATGCAAATGCAGATGACTCCAAGAAAATGATGAACCTTGTAAAGAAATTATCAGGCCAAGAAGA
ATGCTACAAGAGAAGATAGAAGAAATAGCTGCTAAATATAAACATTTAGTAGTGAAGAAATGTTGTTACGATGGAGTCCGTATTAATCATGATGAA
ACCTGTGAGCAGCGAGCTGCACGGATTAGTGTAGGGCCGAGATGCGTCAAAGCTTTCACTCAATGTTGTGTCGTCGCAAGCCAGCTCCGTGCTAATA
ACTCTCATAAAGACTTGCAATTGGGAAGGCTACACATGAAGACCCTGTTACCCAGTAACGAACAAGCCAGAAATTCGGAGTTTATTTTCCAGAAAGCTGGTT
ATGGGAAGTTCATCTTGTCCAGAAGAAAACAGTTGCAGTTTGCCCTACCTGATTCTGTAACTACCTGGGAAATTCAAGGTGTTGGCATTTCAAACA
GTGGTATATGTGTTGCTGATACTATTAAGGCAAAGGTGTTCAAAGATGTCTTCCTGGAAATGAATATACCATATTCTGTTGTACGAGGAGAACAGGT
CCAGTTGAAAGGAACTGTTTACAACTTATAGGGACTTCTGGGATGCAGTTCTGTGTTAAAATGTCTGCTGTGGAGGGAATCTGCACTTCAGAAAGCCCA
GTCATTGATCATCAGGGCACAAAGTCCTCCAAATGTGTGGCGACAGAAAGTAGAGGGCTCCTCTAATCACTTGCTGACCTTTACTGTGCTTCCTCTGGA
AATTGGCCTTCAGAACATCAATTTCTCACTGGAGACTTCGTTTGGAAAAGAAATCTTAGTAAAATCGTTACGAGTGGTGCCAGAAGGTGTCAAAAGG
GAAAGCTATTCTGGTATTACTTTGGATCCTAGGGGTATTTATGNNNNNNNNNNNNNNNNNNNNNNNCGAAAGGAGTTCCCATACAGGATACCATTAGA
TTTGGTCCCCAAAACAGAAATCAAAAGGATTTTGAGTGTAAAAGGACTGCTTGTAGGTGAGATCTTGTCTGCAGTTCTAAGTCGGGAAGGCATCAAT
ATCCTAACCCACCTCCCCAAAGGGAGTGCAGAGGCGGAGCTGATGAGCGTTGTCCCAGTATTCTATGTTTTTCACTACCTGGAAACAGGAAATCATT
GGAACATTTTTCATTCCGACCCATTAATTGAAAAGCGGGAACCTGGAGAAAAAATTAAAAGAAGGGATGGTGAGCATTATGTCCTACAGAAATGCTG
ACTATTCTTACAGCGTGTGGAAGGGTGGCAGTGCTAGCACTTGGTTAACAGCTTTTGCTTTAAGAGATACTTGGACAAGTACATAAATATGTAGAGCA
GAACCAAAATTCAATATGTAATTCTTTATTGTGGCTGGTTGAGAATTATCAGTTAGATAATGGATCCTTCAAGGAAAATTCACAGTATCAACCAATAA
AATTACAGAAAATCAACACAGCTCTAATTAAAGCTGACACCTTTCTGCTTGAAAAATACACTGCCAGCCCAGAGCACCTTTACATTGGCCATTTCTGCCT
ATGCTCTTTCCCTGGGAGATAAAACTCACCCACAGTTTTGTTCAATTGTTTCAGCTTTGAAGAGAAGCTTTGGTTAAAGGTAATCCACCCATTTATC
GTTTTTGGAAAGACAGTCTTCAACATAAAGACAGCTCTGTACCTAACACTGGTACAGCACGTATGGTAGAAACAACTGCCTATGCTTTACTCACCAGT
CTGAACTTGAAAGACATAAATATGTTAACCAATCATCATCAAAATGGCTATCAAGAGAGCAGAGGTATGGAGGTGGCTTTTATTCAACCCAGGACACAA
TCAATGCCATCGAGGGCCTGACAGAATATTCACTCCTGGTTAAACAGCTCCGCTTGAATATGGACATCGATGTTGCTTACACAGCTAAAGGTCCCTTA
CATAATTATAAAATGACAGACAAGAATTTTCCTTGGGAGGCCAGTAGAGGTGCTTCTCAATGATGACCTCGTTGTCAGTACAGGGATTGGCAGTGGCT
TGGCTACGGTACATGTAACAACTGTAGTTCACAAAACCAGTACCTCTGAGGAAGTTTGCAGCTTTTATTTGAAAATTGATACTCAGGATATTGAAGCA
TCCCACCTACGAGGGCTACGGAAACTCTGATTACAAACGCATAGTAGCATGTGCCAGCTACAAGCCCAGCAAGGAAGAAATCATCTTCTGGATCCTCTC
ATGCAGTGATGGACATCTCCTTGCCTACTGGATCAATGCAAGGAAGAGAGCTTAAAAGCTCTTGGGAAGGGGTCGATCAGCTATTCACTGATTA
CCAAATAAAAGATGGACATGTTATTCTGCAACTGAATTCGATCCCCTCCAGTGATTTCCTTTGTGTACGATTCCGGATTTTTGAACTCTTTGAAGTTGG
GTTTCTTAGTCCTGCCACTTTCACAGTGTATGAATACCACAGACCAGATAAACAGTGTACCGATGTTTTATAGCACTTCCAATATCAAAATTCAGAAAGT
CTGTGAAGGAGCCACGTGCAAGTGTATACAAGCTGATTGTGGGCAAATGCAGAAAGAATTGGATCTGACAATCTCTGCAGAGACTAGAAAACAAAC
AGCATGTAACCCAGAGATTGCATATGCTTAAAAGTTATCATCACATCCATCACTAACAGAGAAAATGTTTTTGTCAAGTACAAGGCAACCCTTCTGGATAT
CTACAAACTGGGGAAGCTGTTGCTGAAAAAGACTCTGAAAATCACCTTCATTAAAAAGGTAACCTGCACTAACGCTGAGCTGGTGAAAGGAAGACA
GTACTTAATTATGGGGAAAGAAGCTCTCCAGATAAAATACAATTTCACTTTCAGGTACATCTACCCTTAGAATTCCTTGACCTGGATTGAATACTGCC
TAGAGACACAACATGTTCATCCTGTCAAGCATTTTTAGCTAATTAGATGAATTTGCTGAAGACATCTTTTTAAATGGATGCTAAAATTCCTGAAGTTC
AGCTGCATACAGTTTGCACTTATGGACTCCTGTTGTTGAAGTTTGTTTTTTTTCTCGTTTTTTGTCTTTAAACATTCACAGCTGGTCTTATTTGTAAAG
CTCACTTTACTTAGAATTAGTGGCACTCTGCTTTTATTAGAGAATGATTTTAAACGCTGTAACTTTCTGAAATAACATGGCCTTGGAGGGCGAAAGAACAC
AGATACTCCTCCAAGGTTATTGGACACCGGAAACAATAAATTAGAACACCTCCTCAAACCTACCACTTAGGAATGTTTGCTGGAGCCGAAACAG
TCCATTGAAATGGAGTATTACAAAAACATGGCCTTTGCTTGAAAGAAAATACCAGGGGACAGGAAACTGATCATTAAAGCCTGAGTTTGCTTTCAAA
CTGTGCTAAAAA

Figure 18B

SEQ ID NO:3>gi|291575171|ref|NM_010406.2| Mus musculus hemolytic complement (Hc),
mRNATTTAAAAGGAAAGTGGTTACAGGGAGGCCATGCCCATGGGTTTATGCCGCTACCAGCCATGGGTCTTTGGGGAATACTTTGTCTTTTAATTTT
CCTGGACAAAACTTGGGGACAGGAACAAACCTACGTCATTTCAGCACCCAAAATCCTCCGGGTCGGCTCGTCTGAAAATGTGGTAATTCAAGTCCAT
GGCTACACTGAAGCATTTGATGCAACTCTTTCTCTAAAAAGCTATCCTGACAAAAAAGTCACCTTCTCTTCAGGCTATGTTAATTTGTCCCCGGAAAAC
AAATTCCAAAACGCGGCACTGTTGACACTACAGCCCAATCAAGTTCCTAGAGAAGAAAGCCCAGTCTCTCACGTGTATCTGGAAGTTGTGTCAAAAC
ACTTTTCAAAATCAAACAAAATACCAATTACCTATAACAATGGAATTCTCTTCATCCATACAGACAAACCTGTTTACACGCCGGACCAGTCAGTAAAG
ATCAGAGTCTATTCTCTGGGTGACGACTTGAAGCCAGCCAAACGGGAGACTGTCTTAACTTTCATAGACCCCGAAGGATCAGAAGTTGACATTGTAG
AAGAAAATGATTACACCGGAATTATCTCTTTTCCTGACTTCAAGATTCCATCTAATCCCAAGTATGGTGTTTGGACAATTAAAGCTAACTATAAGAAG
GATTTTACAACAACTGGAACTGCATACTTTGAAATTAAAGAATATGTCTTGCCACGGATTCTCTGTTTCAATAGAACTAGAAAGAACCTTCATTGGCTAT
AAAAACTTTAAGAACTTTGAAATCACTGTGAAAGCAAGATATTTTATAATAAAGTGGTACCTGATGCTGAAGTGTATGCCTTTTTTGGATTGAGACA
GGACATAAAAGATGAGGAGAAGCAGATGATGCACAAAGCCACACAAGCCGCAAAGTTGGTTGACGGAGTTGCTCAGATCTCTTTTGATTCTGAAAC
AGCAGTTAAAGAGCTGTCCTACAACAGTCTAGAAGACTTAAACAACAAGTACCTTTATATTGCAGTAACAGTCACAGAATCTTCAGGTGGATTTTCAG
AAGAGGCAGAAATCCCTGGAGTCAAATATGTCCTCTCTCCCTACACACTGAATTTGGTCGCTACTCCTCTTTTCGTGAAGCCCGGGATTCCATTTTCCA
TCAAGGCACAGGTTAAAGATTCACTCGAGCAGGCGGTAGGAGGGGTCCCAGTAACTCTGATGGCACAAACAGTCGATGTGAATCAAGAGACATCTG
ACTTGGAAACAAAAGAGGAGCATCACTCATGACACTGATGGAGTAGCTGTGTTTGTGCTGAACCTCCCATCAAATGTGACGGTGCTAAAGTTTGAGAT
CAGAACTGATGACCCAGAACTTCCCGAAAGAAAATCAAGCCAGCAAAGAGTACGAAGCAGTTGCGTACTCGTCTCTCAGCCAAAGTTACATTTACATC
GCTTGGACTGAAAACTACAAGCCCATGCTTGTGGGAGAATACCTGAATATTATGGTTACCCCCAAGAGCCCATATATCGACAAAATAACTCACTATAA
TTACTTGATTTTATCCAAAGGCAAAATTGTACAGTACGGCACAAGAGAGAAACTTTTCTCCTCAACTTATCAAAAATATAAATATTCCAGTGACACAGA
ACATGGTTCCTTCAGCACGACTCCTGGTCTATTACATAGTCACAGGGGAGCAAACAGCAGAATTAGTGGCTGACGCAGTCTCTGGATAAATATTGAGGA
GAAGTGTGGCAACCAGCTCCAGGTCCATCTGTCTCCAGATGAATATGTGTATTCTCCAGGCCAAACTGTGTCCCTTGACATGGTGACTGAAGCAGACT
CATGGGTAGCACTATCAGCAGTGGACAGCTGTGTATAAAGTCCAGGGAAACGCCAAAAGGGCCATGCAAAGAGTCTTTCAAGCTTTGGATGAAA
AGAGTGACCTGGGCTGTGGGGCAGGTGGTGGCCATGACAATGCAGATGTATTCCATCTAGCTGGGCTCACCTTCCTCACCAACGCAAACGCAGATG
ACTCCCATTATCGTGATGACTCTTGTAAAGAAATTCTCAGGTCAAAGAGAAACCTGCATCTCCTAAGGCAGAAAATAGAAGAACAAGCTGCTAAGTA
CAAACATAGTGTGCCAAAGAAGTCTGCTATGACGAGGGCCGAGTGAACTTCTACGAAACCTGTGAGGGAGCGAGTGGGCCCGGGTTACCATAGGCCC
TCTCTGCATCAGGGCCTTCAACGAGTGCTGTACTATTGCGAACAAGATCCGAAAAGAAGCCCCCATAAACCTGTCCAACTGGGAAGGATCCACATT
AAGACCCTGTTACCAGTGATGAAGGCAGATATCCGAAGCTACTTTCCAGAGAGCTGGCTATGGGAAATTCATCGCGTTCCCAAAAGAAAACAGCTGC
AGGTCACGCTGCCTGACTCACTAACGACTTGGGAAATTCAAGGCATTGGCATTTCAGACAATGGTATATGTGTTGCTGATACACTCAAGGCAAAGGT
GTTCAAAGAAGTCTTCCTGGAGATGAACATACCATATTCTGTTGTGCGAGGAGAACAGATCCAATTGAAAGGAACTGTTTTACAACTATATGACCTCA
GGGACAAAGTTCTGTGTTAAAATGTCTGCTGTGAGGGGATCGTGCACTTCAGGAAGCTCAGCTGCTAGCCTTCACACCTCCAGGCCCTCCAGATGTG
TGTTCCAGAGGATAGAGGGCTCGTCCAGTCACTTGGTGACCTTCACCCTGCTTCCTCTGGAAATTGGCCTTCACTCCATAAACTTCTCACTAGAGACCT
CATTTGGGAAAGACATCTTAGTAAAGACATTACGGGTAGTGCCAGAAGGAGTCAAGAGGGAAAGCTATGCCGGCGTGATTCTGGACCCTAAGGGA
ATTCGTGGTATTGTTAACAGACGAAAGGAATTCCCATACAGGATCCCATTAGATTTGGTCCCCAAGACCAAAGTTGAAAGGATTTTGAGTGTCAAAG
GACTGCTTGTAGGGGGAGTTCTTGTCCACGGTTCTGAGTAAGGAAGGCATCAACATCCTAACCAACATCTGCCCAAGGGCAGTGCAGGCAGAAGCTCAT
GAGCATAGCTCCGGTGTTCTATGTTTTCCACTACCTGGAAGCAGGAAACATTGGAATATTTCTATCCTGATACACTGAGTAAAAGACAGAGCCTGG
AGAAAAAAATAAAACAAGGGGTGGTGAGCGTCATGTCCTACAGAAACGCTGACTATTCCTACAGCATGTGGAAGGGGCGAGCGCTAGTACCTGG
CTGACAGCTTTTGCTCTGAGAGTGCTTGGACAGGTGGCCAAGTATCTAAAACAGGATGAAAACTCAATTTGTAACTCTTTGCTATGGCTGGTTGAGA
AGTGTCAGCTGGAAAACGGCTCTTTCAAGGAAAATTCCCAATATCTACCAATAAAATTACAGGGTACTTTGCCTGCTGAAGCCCAAGAGAAAACTTT
GTATCTTACAGCCTTTTCTCATGAATTGGAATTAGAAAAGGCAGTTGACATATGCCCCACCATGAAAATCCACACAGCGCTAGATAAAGCCGACTCCTTCC
TGCTTGAAAACACCCTGCCATCCAAGACACCTTCACACTGGCATTGTAGCCTATGCTCTTTCCCTAGGACAGCAGACATCCACCCGAGGTTTCGTCTA
ATTGTGTCGGCCCTGAGGAAGGAAGCTTTTGTTAAAGGTGATCCGCCCATTTACCGTTACTGGAAGAGATACCCTCAAACGTCAGACAGCTCTGTGCC
CAGCAGCGGCACAGCAGGTATGGTTGAAACCACAGCCTATGCTTGCTGCCAGCCTGAAACTGAAGGATATGAATTACGCCAACCCCATCATCAAG
TGGCTATCTGAAGAGCAGAGGTATGGAGGCGCTTTATTCCACCCAGGATACGGATTCATCCGAGGCCTGACAGAATATTCACTCCTGTTAA
AACAAATTCATTGGATATGGGATACATCAATGTCGCCTACCAAACACGAAGTGACTTCCACAAGTATAAGGTGACAGAAGCATTTCCTGGGGAGGCC
AGTGGAGGTATCTCAATGATGACCTTGTTGTCAGCACAGGCTACAGCAGTGGCTTGGCCACAGTATATGTAAAAACTGTGGTTCACAAAATTAGT
GTCTCTGAGGAATTTTGCAGCTTTTACTTGAAAATTGATACCCAAGATATTGAAGCATCCAGCCACTTCAGGCTCAGTGACTCTGGATTCAAGCGCAT
AATAGCATGTGCCAGCTACAAGCCCAGCAAGGAGGAGTCAACATCCGGGTCCTCTCATGCAGTAATGGATATATCACTGCCGACTGGAATCGGAGC
AAACGAGGAAGATTTACGGGCTCTTGTGGGAAGGACAGTGGATCAACTACTAACTGATCAAACATCAAAGATGGCCATCTGCAACTGAATTCG
ATCCCCTCCAGAGATTTCCTCTGTGTCCGGTTCGGGATATTTGAACTTTTCCAAGTTGGGTTTCTGAATCCTGCTACCTTCACGGTGTACGAGTATCACA
GACCAGATAAGCAGTGCACCATGATTTATAGCATTCTGACACCAGGCTTCAGGAAGTCTGTGAAGGAGCAGCTTGCACATGTGTGGAAGCTGACTG
TGCGCAACTGCAGGCAGAAGTAGACCTAGCCATCTCTGCAGACTCCAGAAAAGAGAAAGCCTGTAAACCAGAGACTGCATATGCTTATAAAGTCAG
GATCACATCACCCACTGAAGAAAATGTTTTTGTCAAGTACACTGCGACTCTTTGGTCACTTACAAACAGGGAAGCTGCTGATGAGAATTCGAG
GTCACCTTCATTAAAAGATGAGCTGTACCAATGCCAACCTGGTGAAAGGGAACGCAGTATTTAATCATGGGCAAAGAGGTTCTGCAGATCAAACAC
AATTTCAGTTTCAAGTATATATACCCTCTAGATTCCTCCACCTGGATTGAATATTGGCCCACAGACACAACGTGTCCATCCTGTCAAGCATTTGTAGAG
AATTTGAATAACTTTGCTGAAGACCTCTTTTAAACAGCTGTGAATGAAAAGTTCTGCTGCACGAAGATTCCTCCTGCGGCGGGGGATTGCTCCTCC
TCTGGCTTGGAAACCTAGCCTAGAATCAGATACACTTTCTTTAGAGTAAAGCACAAGCTGATGAGTTACGACTTTGTGAAATGGATAGCCTTGAGGG
CAGGCGAAAACAGGTCCCCAAGGCTATCAGATGTCAGTGCCAATGACTGAAACAAGTCTGTAAAGTTAGCAGTCAGGGGTGTTGGTTGGGGCCG
GAAGAAGAGACCCACTGAAACTGTAGCCCCTTATCAAAACATATCCTTGCTTGAAAGAAAAATACCAAGGACAGAAAATGCCATAAAATCTTGACTT
TGCACTC

Figure 18C

SEQ ID NO:4>gi|392346248|ref|XM_345342.4| PREDICTED: Rattus norvegicus complement component 5 (C5),
mRNAATGGATAGCACAGAGACCGACAGATGTCCTACAGCCCGCCATCATCTTTCCGGAAACATTAACTCAGTGCTTGCTGCCCTTGTAGGTGGGTTT
TCGGAAGAGGCAGAAATTCCTGGCATCAAATACGTCCTCTCTCCCTATACACTGAATTTGGTCGCTACCCCTCTTTTCCTGAAGCCTGGGATTCCATTT
TCCATCAAGGTACAGGTTAAGGATTCACTCGAGCAGTTGGTAGGAGGGGTCCCAGTAACTCTGATGGCACAAACAGTCAATGTGAATCAAGAGACA
TCTGACTTGGAACCAAAGAGGAGCATCACACACTCTGCTGATGGAGTGGCTTCATTTGTGGTGAACCTCCCATCAGAAGTGACATCACTGAAGTTTG
AGGTCAAAACTGATGCCCCGGAACTTCCCGAAGAAAATCAAGCCAGCAAAGAATATGAAGCAGTTACATACTCATCCCTCAGCCAGAGTTACATTTA
CATTGGCTGGACTGAAAACTACAAGCCCATGCTTGTGGGAGAATATCTGAATATTATCGTCACCCCCAAGAGTCCATATATTGACAAAATAACTCACT
ATAATTACTTGATTTTATCCAAAGGCAAAATTGTACAGTATGGCACAAAGGAGAAACTTCTCTATTCATCTTATCAAAATATAAACATCCCAGTGACAC
AGGACATGGTTCCTTCAGCGCGGCTCCTGGTCTATTACATAGTCACGGGGGAGCAGACAGCAGAATTGGTGGCTGACGCAGTCTGGATAAACATTG
AGGAGAAGTGTGGCAACCAGCTCCAGGTCCATCTGTCTCCAGATAAAGACGTGTATTCTCCAGGCCAAACTGTGTCCCTTGACATGGTGACTGAAGC
AGACTCATGGGTGGCACTATCTGCGGTGGACAGCGCTGTGTATGGAGTCCGGGGAAAAGCCAAAAGGGCCATGCAAAGAGTGTTCCAAGCTTTTGA
TGACAAGAGTGACCTGGGCTGTGGGGCAGGTGGTGGCCGTGACAATGTAGATGTATTCCATCTAGCTGGGCTCACCTTCCTCACCAATGCAAACGCA
GATGACTCCCAATACCACGATGACTCTTGTAAGGAAATTCAGGCCAAAGGAGAGCCTGCAGCTCCTGCATCAGAAAGTGGAAGAACAAGCTGCT
AAATACAAACACCGTGTGCCCAAGAAATGCTGTTATGATGGAGCCCGAGAAAACAAATACGAAACCTGTGAGCAGCGAGTTGCCCGGGTGACCATA
GGCCCACACTGCATCAGGGCCTTCAACGAGTGTTGTACTATTGCGGATAAGATCCGAAAAGAAAGCCACCACAAAGGCATGCTGTTGGGAAGGATC
CAAATAAAGGCCCTGTTACCAGTGATGAAGGCAGAAATCCGAAGCTACTTTCCAGAGAGCTGGCTATGGGAAGTTCATCGTGTTCCCAAAAGAAACC
AGCTGCAGGTTGCACTGCCTGACTCACTGACGACCTGGGAAATTCAAGGCATCGGCATCTCAGACAATGGTATATGTGTTGCTGACACACTCAAGGC
AAAGGTGTTCAAAGATGTCTTCCTGGAGATGAACATACCATATTCTGTTGTACGAGGGGGAGCAGATCCAATTGAAGGGAACCTGTTTACAATTATAGG
ACCTCTGGGACAATGTTCTGTGTTAAAATGTCTGCCGTGGAGGGAATCTGCACTCCAGGAAGCTCGGCTGCTAGCCCTCAGACCTCTAGGTCCTCCAG
ATGTGTGCGCCAGAGAATAGAGGGCTCCTCCAGTCACTTGGTGACCTTCAGCCTGCTTCCTCTGGAAATTGGCCTTCACTCCATAAACTTCTCACTAGA
GACTTCATTTGGGAAAGAAATCTTAGTGAAGACATTACGGGTAGTGCCAGAAGGGATCAAAAGGGAAAGCTATGCTGGTGTGACTCTGGACCCCAG
GGGAGTTTATGGTATTGTTAACAGACGAAAGGAATTCCCATACAGGATACCATTAGATTTGGTCCCCAAAACCAACGTCAAAAGGATTTTGAGTGTA
AAAGGACTGCTTATAGGGGAATTCTTGTCCACGGTTCTGAGTAAAGAAGGCTATTGCCCCCACGGAGAAAATCTACACAGCCGCTGGCTAAAGCTGACTCCT
CTCATGGAGCATAGTCCCGGTGTTCTACGTTTTCCACTACCTGGAAGCAGGAAACCATTGGAATATTTTCCACCCTGATACGTTAGCTAGAAAACAGAG
CCTGCAGAAAAAATAAAAGAGGCTGGTGAGCGTCATGTCCTACAGAAACGCTGACTATTCCTACAGCATGTGAAGGGAGCAAGCTCTAGTGC
CTGGCTGACAGCTTTTGCTCTGAGAGTGCTTGGACAGGTGAACAAGTATGTGAAACAAGACCAATACTCGATCTGTAACTCCTTGTTATGGCTGATTG
AGAAGTGTCAGCTGGAAAACGGATCTTTCAAGGAAAATTCCCAATATCTACCAATAAAATTACAGGGTACTTTGCCTGCTGAAGCCCAAGAGAACAC
TTTATATCTTACAGCCTTTCTGTGATTGGAATTAGAAAGGCTATTGGCATATGCCCCACGGAGAAAATCTACACAGCCGCTGGCTAAAGCTGACTCCT
TCCTACTTGAAAGGACCCTGCCTTCCAAGAGACCACCTTCACCCTGGCCATTGTGGCCTATGCTCTCTCCCTGGGAGACAGAACCCACCCGAAGTTTCGTT
CTATTGTGTCAGCCCTGAAGAGGGAAGCTTTGGTTAAAGGAGACCCGCCCATTTACCGTTTCTGGAGAGACACTCTCCAACGTCCAGACAGCTCAGC
ACCCAACAGCGGCACAGCAGGTATGGTAGAAACCACGGCCTATGCTTTGCTCACCAGCCTGAACCTGAAGGAGACGAGTTATGTCAACCCGATCATC
AAGTGGCTATCTGAGGAGCAGAGGTATGGAGGCGGCTTTTATTCCACCCAGGATACCATTAACGCCATCGAGGGCCTGACAGAGTATTCACTCCTGG
TTAAACAACTTCATTTGGATATGGATATCAATGTCTCCTACAACACAAAGGGGATTTCTACCAGTATAAACGTGACAGAGAAGAACTTCCTCGGGGAG
GCCAGTGGAGGTACCCCTCAATGATGATGACCTCATCGTCACCACAGCCGCTATAGCAGTGGCTTGGCTACAGTATATGTAAAAACTGTGGTTCACAAAACT
AGTGTCGCTGAGGAATTTTGCAGCTTTTACTTGAAAATTGATACCCAAGAAGTTGAAGCCTCCACGTACCTCAGCTACAGTGACTCGGGACACAAGC
GCAATAATAGCCTGTGCCAGCTACAAGCCCAGCAAGGAGGAGTCAGCATCTGGGTCCTCCATGCAGTAATGGATATACTGCTGCCGACCGGAATCG
GAGCAAACCAAGAAGATTTACGAGCTCTTGTGGAAGGAGTAGATCAACTCCTAACTGATTACCAGATCAAAGACAGTCATGTTATTCTGCAATTGAA
TTCGATTCCCTCCAGAGATTTCCTTTTGTGTTCGGTTCCGGATATTTGAACTTTTCCAAGTTGGGTTTCTGAATCCTGCTACGTTCACGGTGTACGAGTAT
CACAGACCAGATAAGCAGTTACCATGATTTACAGCACTTCTGAAGACATTCAGAGAGTCTGTGAAGGAGCGCATGCAAATGCGTTGAAGCTG
ATTGTGGGCAACTGCAGGCAGAACTGGACCTGGCCATCTCTGCAGACACCAGGAAGAAACAGCATGTAAACCAGAGATTGCATATGCTTATAAGG
TCAGGATCACGTCGCCACGGAAGAAAACATTTTTGTCAAGTACACTGCGACGCTTCTGGATATTTACAAAACAGGGGAAGCCGCTGCTGAGAAGG
ACTCTGAGATCACCTTCATTAAAAAGATAAGCTGTACCAACGCCAACCTGGTGAAAGGAAAGCAATATTTAATCATGGGCAAGAGGCTCTGCAGAT
CAAACACAATTTCAGTTTCAAGTATATATACCCTCTAGATTCCTCCACCTGGATTGAATATTGGCCCCACAGACAGAACGTGTCCATCCTGCCAAGCGTT
TGTAGCTAATTTGGACGAGTTCGCTGAAGACATCTTTCTAAATGCCTGTGAAAATGCCTGAGGAAGTTCTGCTCGTGGCCTTCCCGGGTACTCCTGT
TGGTGGCTCCTAGGAGCCAGGATCGCTTGGAACTTAGCCTAGAATCGGATACATTTTCTTTATAGTAAAGCGTAAGTTGAAGAGTTACTTTGTGAA
ACAAAATGCCTTGTGGAGAGCCGAAGGCAGGTCCCCCAAGGCTATTGGACATCAGCACCAATAAGCTGGAACAAGTCTGTAACGTTAGCAGCCAG
GGGTGTTTGTTGGGGCCGGAAGAAGAGACTCACTGAAATTGTAGCCCCTTAGGAAAACATGGTCTTGCTTCAAAAAAAAATACCAAGGACAGAAA
ATGCCATAAAAGCTTGACTTTGCACTCAACTGTA

SEQ ID NO:7 Reverse Complement of SEQ ID NO:3
GAGTGCAAAGTCAAGATTTTATGGCATTTTCTGTCCTTGGTATTTTTCTTTCAAGCAAGGATATGTTTTGATAAGGGGCTACAGTTTCAGTGGGTCTCT
TCTTCCGGCCCCAACCAACACCCCTGACTGCTAACTTTACAGACTTGTTTCAGTCTATTGGCACTGACATCTGATAGCCTTGGGGGACCTGTTTTCGCC
TCCCCTCAAGGCTATCCATTTCACAAAGTCGTAACTCATCAGCTTGTGCTTTACTCTAAAGAAAGTGTATCTGATTCTAGGCTAGGTTTCCAAGCCAGA
GGAGGAGCAATCCCCCCGCCGCAGGAGGAATCTTCGTGCAGCAGAACTTTTCATTCACAGCTGTTTAAAAAGAGGTCTTCAGCAAAGTTATTCAAAT
TCTCTACAAATGCTTGACAGGATGGACACGTTGTCTCTGTGGGCCAATATTCAATCAGGTGGAGGAATCTAGAGGGTATATATACTTGAAACTGAA
ATTGTGTTTGATCTGCAGAACCTCTTTGCCCATGATTAAATACTGCTTCCCTTTCACCAGGTTGGCATTGGTACAGCTCATCTTTTTAATGAAGGTGACC
TCCGAATTCTCATCAGCAGCTTCCCCTGTTTTGTAAGTGACCAGAAGAGTCGCAGTGTACTTGACAAAAACATTTTCTTCAGTGGCTGATGTGATCCTG
ACTTTATAAGCATATGCAGTCTCTGGTTTACAGGGCTTTCTCTTTTCTGGAGTCTGCAGAGATGGCTAGGTCTACTTCTGCCTGCAGTTGCGCACAGTCA
GCTTCCACACATGTGCAAGCTGCTCCTTCACAGACTTTCTGAAGCCTGGTGTCAGAAATGCTATAAATCATGGTGCACTGCTTATCTGGTCTGTGATAC
TCGTACACCGTGAAGGTAGCAGGATTCAGAAACCCAACTTGGAAAAGTTCAAATATCCGGAACCGGACACGAGGAAATCTCTGGAGGGGATCGA
ATTCAGTTGCAGAATGACATGGCCATCTTTGATCTGGTAATCAGTTAGTAGTTGATCCACTCCTTCCACAAGAGCCCGTAAATCTTCCTCGTTTGCTCC
GATTCCAGTCGGCAGTGATATATCCATTACTGCATGGGAGGACCCGGATGTTGACTCCTCCTTGCTGGGCTTGTAGCTGGCACATGCTATTATGCGCT
TGAATCCAGAGTCACTGAGCCTGAAGTGGCTGGATGCTTCAATATCTTGGGTATCAATTTTCAAGTAAAAGCTGCAAAATTCCTCAGAGACTAATT
TTGTGAACCACAGTTTTACATATACTGTGGCCAAGCCACTGCTGTAGTTTCTGCTGGACAACAAGGTCATCATTGAGAGATACCTCCACTGCCCTCCC
CAGGAAATGCTTCTCTGTCACCTTATACTTGTGGAAGTCACCTTCGTGTTTGTAGGGGACATTGATGTCCATATCCAAATGAAATTTGTTTTAACAGGAG
TGAATATTCTGTCAGGCCCTCGATGGCATTAATCGTATCCTGGGTGGAATAAAAGCCGCCTCCATACCTCTGCTCTTCAGATAGCCACTTGATGATGG
GGTTGGCGTAATTCATATCCTTCAGTTTCAGGCTGGCGAGCAAAGCATAGGCTGTGGTTTCAACCATACCTGCTGTGCCGCTGCTGGGCACAGAGCT
GTCTGGACGTTTGAGGGTATCTCTCCAGTAACGGTAAATGGGCGGATCACCTTTAACAAAAGCTTCCTTCCTCAGGGCCGACACAATTAGACGAAAC
CTCGGGTGGGTTCTGTCTCCTAGGGAAAGAGCATAGGCTACAATGGCCAGTGTGAAGGTGCTCTTGGATGGCAGGGTGTTTTCAAGCAGGAAGGAG
TCGGCTTTATCTAGCGCTGTGTGGATTTTCATGGTGGGGCATATGTCAACTGCCTTTCTAATTCCAATCACAGAAAAGGCTGTAAGATACAAAGTTTT
CTCTTGGGCTTCAGCAGGCAAAGTACCCTGTAATTTTATTGGTAGATATTGGGAATTTTCCTTGAAAGAGCCGTTTTCCAGCTGACACTTCTCAACCAG
CCATAGCAAAGAGTTACAAATTGAGTTTTCATCCTGTTTTACATACTTGGCCACCTGTCCAAGCACTCTCAGAGCAAAAGCTGTCAGCCAGGTACTAG
CGCTCGCCCCCTTCCACATGCGTAGGAATAGTCAGCGTTTCTGTAGGACATGACGCTCACCACCCGTGTTTTATTTTTTCCAGGCTCTGTCTTTT
ACTCAGTGTATCAGGATAGAAAATATTCCAATGGTTTCCTGCTTCCAAGGTAGTGCAAAACATAGAACACCGGAGCTATGCTCATGAGCTCTGCCTCTG
CACTGCCCCTTGGGGAGGTGGGTTAGGATGTTGATGCCTTCCTTACTCAGAACCGTGGACAAGAACTCCCCTACAAGCAGTCCTTTGACACTCAAAATC
CTTTCAACTTTGGTCTTGGGGACCAAATCTAATGGGATCCTGTATGGGAATTCCTTTCGTCTGTTAACAATACCACGAATTCCCTTAGGGTCCAGAATC
ACGCCGGCATAGCTTTCCCTCTTGACTCCTTCTGGCACTACCCGTAATGTCTTTTACTAAGATGTCTTTCCCAAATGAGGTCTCTAGTGAGAAGTTTATG
GAGTGAAGGCCAATTTCCAGAGGAAGCAGGGTGAAGGTCACCAAGTGACTGGACGAGCCCTCTATCCTCTGGAACACACATCTGGAGGGCCTGGA
GGTGTGAAGGCTAGCAGCTGAGCTTCCTGAAGTGCAGATCCCCTCCACAGCAGACATTTTAACACAGAACTTGTCCCTGAGGTCATATAGTTGTAA
ACAGTTCCTTTCAATTGGATCTGTCTCCTCCGCACAACAGAATATGGTATGTTCATCTCCAGGAAGACTTCTTTGAAACACCCTTTGCCTTGAGTGTATCA
GCAACACATATACCATTGTCTGAAATGCCAATGCCTTGAATTTCCCAAGTCGTTAGTGAGTCAGGCAGCGTGACCTGCAGCTGTTTCTTTTGGGAAC
GCGATGAATTTCCCATAGCCAGCTCTCTGGAAAGTAGCTTCGGATATCTGCCTACTGGTAACAGGGTCTTAATGTGGATCCTCCCAGTTGGA
CAGGTTTATGGGGGCTTTCTTTTCGGATCTTGTTCGCAATAGTACACACTCGTTGAAGGCCCTGATGCAGAGAGGGCCTATGGTAACCCGGGCCAC
TCGCTCCTCACAGGTTTCGTAGAAGTTCACTCGGGCCTCCGTCATAGCAGCATTTCTTTGGCACACTATGTTTGTACTTAGCAGCTTGTTCTTCTATTTC
TGCCTTAGGAGATGCAGGTTTCTCTTTGACCTGAGAATTTCTTTACAAGAGTCATCACGATAATGGGAGTCATCTGCGTTTGCGTTGGTGAGGAAGGT
GAGCCCAGCTAGAATGAAATACATCTGCATTGTCATGGCCACCACCTGCCCCACAGTGGCCACTCACTCTTTTCATCCAAAGCTTGAAAGACTCTTTGCAT
GGCCCTTTTGGCGTTTCCCTGGACTTTATACACAGCTCTGTCCACTGCTGATAGTGCTACCCATGAGTCTGCTTCAGTCACCATGTCAAGGGACACAGT
TTGGCCTGGAGAATACACATATTCATCTGGAGACAGATGGACCTGGAGCTCGGTTGCCACACTTCTCCTCAATATTTATCCAGACTGCGTCAGCCACTA
ATTCTGCTGTTTGCTCCCCTGTGACTATGTAATAGACCAGGAGTCGTGCTGAAGGAACCATGTTCTGTGTCACTGGAATATTTATATTTTGATAAGTTG
AGGAGAAAAGTTTCTCTCTTGTGCCGTACTGTACAATTTTGCCTTTGGATAAAATCAAGTAATTATAGTGAGTTATTTTGTCGATATATGGGCTCTTGG
GGGTAACCATAATATTCAGGTATTCTCCCACAGACATGGCTTGTAGTTTTCAGTCCAGGCGATGTAAATGTAACTTTGGCTGAGAGAGCGAGTACGC
AACTGCTTCGTACTCTTTGCTGGCTTGATTTCTTCGGGAAGTTCTGGGTCATCAGTTCTGATCTCAAACTTTAGCACCGTCACATTTGATGGGAGGTT
CAGCACAAACACAGCTACTCCATCAGTGTCATGAGTGATGCTCCTCTTTGTTTCAAGTCAGATGTCTCTTGATTCACATCGACTGTTTGTGCCATCAG
AGTTACTGGGACCCCTCCTACCGCCTGCTCGAGTGAATCTTTAACCTGTGCCTTGATGGAAAATGGAATCCCGGGCTTCACGAAAAGAGGAGTAGCG
ACCAAATTCAGTGTGTAGGGAGAGGACGATATTTGACTCCAGGGATTTCTGCCTCTTCGAAAATCCACCTGAAGATTCTGTGACTGTTACTGCAAT
ATAAAGGTACTTCGTTGTTTAAGTCTTCTAGACTGTTGTAGGACAGCTCTTTAACTGCTGTTTCAGAATCAAAAGAGATCTGAGCAACTCCGTCAACCA
ACTTTGCGGCTTGTGTGGCTTTGTGCATCATCTGCTTCTCCTCATCTTTATGTCCCTCTCAATCCAAAAAAGGCATACACTTCAGCATCAGGTACCAC
TTTATTATAAAAATATCTTGCTTTCACAGTGATTCAAAGTTCTTAAAGTTTTATAGCCAATGAAGGTTCTTTCTAGTTCTATTGAAACAGAGAATCGT
GGCAAGACATATTCTTTAATTTCAAAGTATGCAGTTCCAGTTGTTCTAAAATCCTTCTTATAGTTAGCTTTAATTGTCCAAACACCATACTTGGGATTA
GATGGAATCTTGAAGTCAGAAGAGATAATTTCCGGTGTAATCATTTTCTTCTACAATGTCAACTTCCTTCGATCCTTCGGGGTCTATGAAAGTTAAGAC
AGTCTCCCGTTTGGCTGGCTTCAAGTCGTCACCCAGAGAATAGACTCTGATCTTTACTGACTGGTCCGGCGTGTAAACAGGTTTGTCTGTATGGATGA
AGAGAATTCCATTGTTATAGGTAATTGGTATTTTCTTTGATTTTGAAAAGTGTTTTGACACAACTTCCAGATACACGTGAGAGACTGGGCTTTCTTCTC
TAGGAACTTGATTGGGCTGTAGTGTCAACAGTGCCGCGTTTTGGAATTTGTTTTCCGGGGACAAATTAACATAGCCTGAAGAGAAGGTGACTTTTTT
GTCAGGATAGCTTTTTAGAGAAAGAGTTGCATCAAATGCTTCAGTGTAGCCATGGACTTGAATTACCACATTTTCAGACGAGCCGACCCGGAGGATT
TTGGGTGCTGAAATGACGTAGGTTTGTTCCTGTCCCAAGTTTTGTCCAGGAAAATTAAAAGACAAAGTATTCCCCAAAGACCCATGGCTGGTAGCG
GCATAAACCCATGGGCATGGCCTCCCTGTAACCACTTTCCTTTTAAA

COMPLEMENT COMPONENT C5 IRNA COMPOSITIONS AND METHODS OF USE THEREOF

RELATED APPLICATIONS

This application is a 35 U.S.C. 111(a) continuation application, which claims the benefit of priority to PCT/US2014/025882, filed on Mar. 13, 2014; U.S. Provisional Patent Application No. 61/782,531, filed on Mar. 14, 2013; U.S. Provisional Patent Application No. 61/837,399, filed on Jun. 20, 2013; U.S. Provisional Patent Application No. 61/904,579, filed on Nov. 15, 2013; U.S. Provisional Patent Application No. 61/912,777, filed on Dec. 6, 2013; and U.S. Provisional Patent Application No. 61/942,367, filed on Feb. 20, 2014. The entire contents of each of the foregoing patent applications are hereby incorporated herein by reference.

SEQUENCE LISTING

The instant application contains a Sequence Listing which has been submitted electronically in ASCII format and is hereby incorporated by reference in its entirety. Said ASCII copy, created on Apr. 28, 2015, is named 121301-00506_SL.txt and is 734,881 bytes in size.

BACKGROUND OF THE INVENTION

Complement was first discovered in the 1890s when it was found to aid or "complement" the killing of bacteria by heat-stable antibodies present in normal serum (Walport, M. J. (2001) *N Engl J Med.* 344:1058). The complement system consists of more than 30 proteins that are either present as soluble proteins in the blood or are present as membrane-associated proteins. Activation of complement leads to a sequential cascade of enzymatic reactions, known as complement activation pathways, resulting in the formation of the potent anaphylatoxins C3a and C5a that elicit a plethora of physiological responses that range from chemoattraction to apoptosis. Initially, complement was thought to play a major role in innate immunity where a robust and rapid response is mounted against invading pathogens. However, recently it is becoming increasingly evident that complement also plays an important role in adaptive immunity involving T and B cells that help in elimination of pathogens (Dunkelberger J R and Song W C. (2010) *Cell Res.* 20:34; Molina H, et al. (1996) *Proc Natl Acad Sci USA.* 93:3357), in maintaining immunologic memory preventing pathogenic re-invasion, and is involved in numerous human pathological states (Qu, H, et al. (2009) *Mol Immunol.* 47:185; Wagner, E. and Frank M M. (2010) *Nat Rev Drug Discov.* 9:43).

Complement activation is known to occur through three different pathways: alternate, classical, and lectin (FIG. 1), involving proteins that mostly exist as inactive zymogens that are then sequentially cleaved and activated. All pathways of complement activation lead to cleavage of the C5 molecule generating the anaphylatoxin C5a and, C5b that subsequently forms the terminal complement complex (C5b-9). C5a exerts a predominant pro-inflammatory activity through interactions with the classical G-protein coupled receptor C5aR (CD88) as well as with the non-G protein coupled receptor C5L2 (GPR77), expressed on various immune and non-immune cells. C5b-9 causes cytolysis through the formation of the membrane attack complex (MAC), and sub-lytic MAC and soluble C5b-9 also possess a multitude of non-cytolytic immune functions. These two complement effectors, C5a and C5b-9, generated from C5 cleavage, are key components of the complement system responsible for propagating and/or initiating pathology in different diseases, including paroxysmal nocturnal hemoglobinuria, rheumatoid arthritis, ischemia-reperfusion injuries and neurodegenerative diseases.

To date, only one therapeutic that targets the C5-C5a axis is available for the treatment of complement component C5-associated diseases, the anti-C5 antibody, eculizumab (Soliris®). Although eculizumab has been shown to be effective for the treatment of paroxysmal nocturnal hemoglobinuria (PNH) and atypical hemolytic uremic syndrome (aHUS) and is currently being evaluated in clinical trials for additional complement component C5-associated diseases, eculizumab therapy requires weekly high dose infusions followed by biweekly maintenance infusions at a yearly cost of about $400,000. Accordingly, there is a need in the art for alternative therapies and combination therapies for subjects having a complement component C5-associated disease.

SUMMARY OF THE INVENTION

The present invention provides iRNA compositions which effect the RNA-induced silencing complex (RISC)-mediated cleavage of RNA transcripts of a C5 gene. The C5 gene may be within a cell, e.g., a cell within a subject, such as a human. The present invention also provides methods and combination therapies for treating a subject having a disorder that would benefit from inhibiting or reducing the expression of a C5 gene, e.g., a complement component C5-associated disease, such as paroxysmal nocturnal hemoglobinuria (PNH) and atypical hemolytic uremic syndrome (aHUS) using iRNA compositions which effect the RNA-induced silencing complex (RISC)-mediated cleavage of RNA transcripts of a C5 gene for inhibiting the expression of a C5 gene.

Accordingly, in one aspect, the present invention provides a double-stranded ribonucleic acid (dsRNA) agent for inhibiting expression of complement component C5, wherein the dsRNA comprises a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5.

In another aspect, the present invention provides a double-stranded ribonucleic acid (dsRNA) agent for inhibiting expression of complement component C5, wherein the dsRNA comprises a sense strand and an antisense strand, the antisense strand comprising a region of complementarity which comprises at least 15 contiguous nucleotides differing by no more than 3 nucleotides from any one of the antisense sequences listed in any one of Tables 3, 4, 5, 6, 18, 19, 20, 21, and 23.

In one embodiment, the sense and antisense strands comprise sequences selected from the group consisting of A-118320, A-118321, A-118316, A-118317, A-118332, A-118333, A-118396, A-118397, A-118386, A-118387, A-118312, A-118313, A-118324, A-118325, A-119324, A-119325, A-119332, A-119333, A-119328, A-119329, A-119322, A-119323, A-119324, A-119325, A-119334, A-119335, A-119330, A-119331, A-119326, A-119327, A-125167, A-125173, A-125647, A-125157, A-125173, and A-125127. In another embodiment, the sense and antisense strands comprise sequences selected from the group consisting of any of the sequences in any one of Tables 3, 4, 5, 6, 18, 19, 20, 21, and 23. In one embodiment, the dsRNA agent comprises at least one modified nucleotide.

In one aspect, the present invention provides a double-stranded ribonucleic acid (dsRNA) agent for inhibiting expression of complement component C5, wherein the dsRNA agent comprises a sense strand and an antisense strand, wherein the sense strand comprises the nucleotide sequence AAGCAAGAUAUUUUUAUAAUA (SEQ ID NO:62) and wherein the antisense strand comprises the nucleotide sequence UAUUAUAAAAAUAUCUUGCU-UUU (SEQ ID NO:113). In one embodiment, the dsRNA agent comprises at least one modified nucleotide, as described below.

In one aspect, the present invention provides a double stranded RNAi agent for inhibiting expression of complement component C5 wherein the double stranded RNAi agent comprises a sense strand and an antisense strand forming a double-stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, wherein substantially all of the nucleotides of the sense strand and substantially all of the nucleotides of the antisense strand are modified nucleotides, and wherein the sense strand is conjugated to a ligand attached at the 3'-terminus.

In one embodiment, all of the nucleotides of the sense strand and all of the nucleotides of the antisense strand comprise a modification.

In one embodiment, substantially all of the nucleotides of the sense strand are modified nucleotides selected from the group consisting of a 2'-O-methyl modification, a 2'-fluoro modification and a 3'-terminal deoxy-thymine (dT) nucleotide. In another embodiment, substantially all of the nucleotides of the antisense strand are modified nucleotides selected from the group consisting of a 2'-O-methyl modification, a 2'-fluoro modification and a 3'-terminal deoxy-thymine (dT) nucleotide. In another embodiment, the modified nucleotides are a short sequence of deoxy-thymine (dT) nucleotides. In another embodiment, the sense strand comprises two phosphorothioate internucleotide linkages at the 5'-terminus. In one embodiment, the antisense strand comprises two phosphorothioate internucleotide linkages at the 5'-terminus and two phosphorothioate internucleotide linkages at the 3'-terminus. In yet another embodiment, the sense strand is conjugated to one or more GalNAc derivatives attached through a branched bivalent or trivalent linker at the 3'-terminus.

In one embodiment, at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an abasic nucleotide, a 2'-amino-modified nucleotide, a 2'-alkyl-modified nucleotide, a morpholino nucleotide, a phosphoramidate, a non-natural base comprising nucleotide, a nucleotide comprising a 5'-phosphorothioate group, and a terminal nucleotide linked to a cholesteryl derivative or a dodecanoic acid bisdecylamide group.

In another embodiment, the modified nucleotides comprise a short sequence of 3'-terminal deoxy-thymine (dT) nucleotides.

In one embodiment, the region of complementarity is at least 17 nucleotides in length. In another embodiment, the region of complementarity is between 19 and 21 nucleotides in length.

In one embodiment, the region of complementarity is 19 nucleotides in length.

In one embodiment, each strand is no more than 30 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is

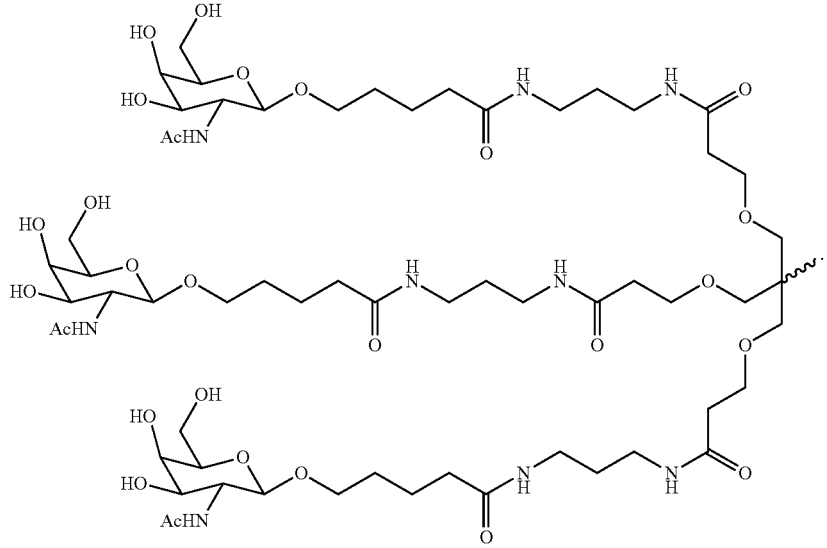 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

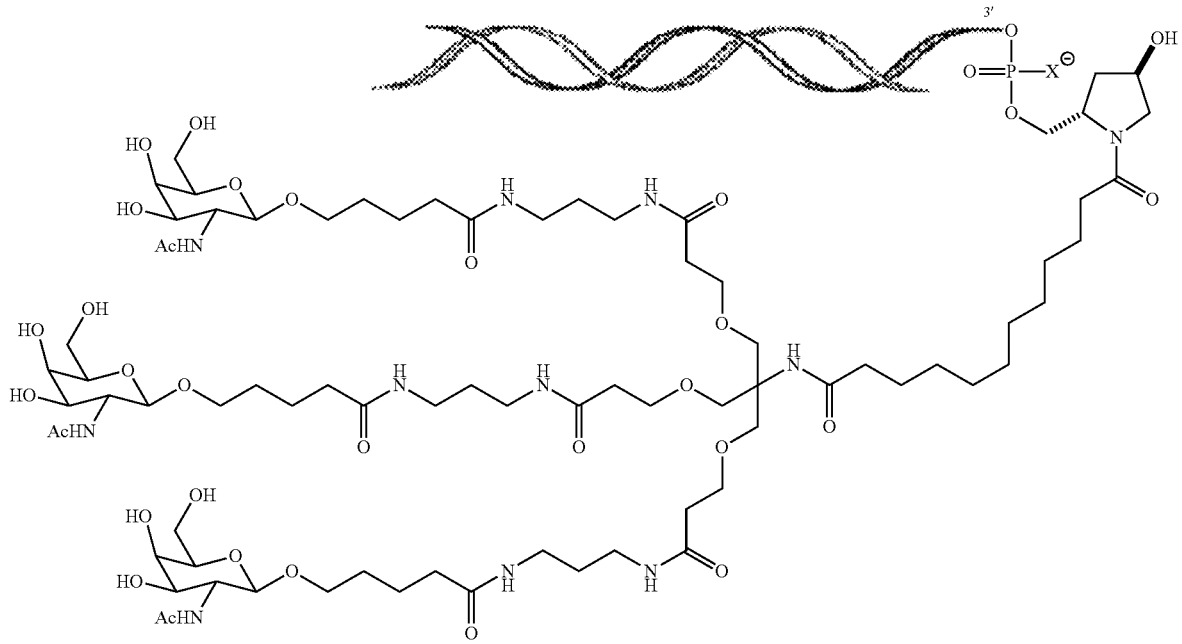

and, wherein X is O or S.

In one embodiment, the X is O.

In one embodiment, the region of complementarity consists of one of the antisense sequences of any one of Tables 3, 4, 5, 6, 18, 19, 20, 21, and 23.

In one embodiment, the dsRNA agent is selected from the group consisting of AD-58123, AD-58111, AD-58121, AD-58116, AD-58133, AD-58099, AD-58088, AD-58642, AD-58644, AD-58641, AD-58647, AD-58645, AD-58643, AD-58646, AD-62510, AD-62643, AD-62645, AD-62646, AD-62650, and AD-62651.

In another aspect, the present invention provides a double-stranded ribonucleic acid (dsRNA) agent for inhibiting expression of complement component C5, wherein the dsRNA agent comprises a sense strand and an antisense strand, wherein the sense strand comprises the nucleotide sequence AAGCAAGAUAUUUUAUAAUA (SEQ ID NO:62) and wherein the antisense strand comprises the nucleotide sequence

```
UAUUAUAAAAAUAUCUUGCUUUUdTdT.    (SEQ ID NO: 2899)
```

In another aspect, the present invention provides a double-stranded ribonucleic acid (dsRNA) agent for inhibiting expression of complement component C5, wherein the dsRNA agent comprises a sense strand and an antisense strand, wherein the sense strand comprises the nucleotide sequence asasGfcAfaGfaUfAfUfuUfuuAfuAfauaL96 (SEQ ID NO:2876) and wherein the antisense strand comprises the nucleotide sequence usAfsUfuAfuaAfaAfauaUfcUfuG-fcuususudTdT (SEQ ID NO:2889).

In one aspect, the present invention provides a double stranded RNAi agent capable of inhibiting the expression of complement component C5 in a cell, wherein the double stranded RNAi agent comprises a sense strand complementary to an antisense strand, wherein the antisense strand comprises a region complementary to part of an mRNA encoding C5, wherein each strand is about 14 to about 30 nucleotides in length, wherein the double stranded RNAi agent is represented by formula (III):

```
sense:                                                       (III)
5'  n_p-N_a-(X X X)_i-N_b-Y Y Y-N_b-(Z Z Z)_j-N_a-n_q 3'
antisense:
3'  n_p'-N_a'-(X'X'X')_k-N_b'-Y'Y'Y'-N_b'-(Z'Z'Z')_l-
N_a'-
n_q' 5'
``` wherein:

i, j, k, and l are each independently 0 or 1;

p, p', q, and q' are each independently 0-6;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof;

each $n_p$, $n_p'$, $n_q$, and $n_q'$, each of which may or may not be present, independently represents an overhang nucleotide;

XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b'$ differ from the modification on Y'; and wherein the sense strand is conjugated to at least one ligand.

In one embodiment, i is 0; j is 0; i is 1; j is 1; both i and j are 0; or both i and j are 1.

In one embodiment, k is 0; l is 0; k is 1; l is 1; both k and l are 0; or both k and l are 1.

In one embodiment, XXX is complementary to X'X'X', YYY is complementary to Y'Y'Y', and ZZZ is complementary to Z'Z'Z'.

In one embodiment, the YYY motif occurs at or near the cleavage site of the sense strand.

In one embodiment, the Y'Y'Y' motif occurs at the 11, 12 and 13 positions of the antisense strand from the 5'-end.

In one embodiment, the Y' is 2'-O-methyl.

In one embodiment, formula (III) is represented by formula (IIIa):

```
sense:      5' n_p-N_a-Y Y Y-N_a-n_q 3'         (IIIa)
antisense:  3' n_p'-N_a'-Y'Y'Y'-Na,-n_q' 5'.
```

In another embodiment, formula (III) is represented by formula (IIIb):

```
sense:                                          (IIIb)
5' n_p-N_a-Y Y Y-N_b-Z Z Z-N_a-n_q 3'
antisense:
3' n_p'-N_a'-Y'Y'Y'-N_b'-Z'Z'Z'-N_a'-n_q' 5'
``` wherein each $N_b$ and $N_b'$ independently represents an oligonucleotide sequence comprising 1-5 modified nucleotides.

In yet another embodiment, formula (III) is represented by formula (IIIc):

```
sense:                                          (IIIc)
5' n_p-N_a-X X X-N_b-Y Y Y-N_a-n_q 3'
antisense:
3' n_p'-N_a'-X'X'X'-N_b'-Y'Y'Y'-N_a'-n_q' 5'
``` wherein each $N_b$ and $N_b'$ independently represents an oligonucleotide sequence comprising 1-5 modified nucleotides.

In another embodiment, formula (III) is represented by formula (IIId):

```
sense:                                          (IIId)
5' n_p-N_a-X X X-N_b-Y Y Y-N_b-Z Z Z-N_a-n_q 3'
antisense:
3' n_p'-N_a'-X'X'X'-N_b'-Y'Y'Y'-N_b'-Z'Z'Z'-N_a'-n_q' 5'
``` wherein each $N_b$ and $N_b'$ independently represents an oligonucleotide sequence comprising 1-5 modified nucleotides and each $N_a$ and $N_a'$ independently represents an oligonucleotide sequence comprising 2-10 modified nucleotides.

In one embodiment, the double-stranded region is 15-30 nucleotide pairs in length.

In one embodiment, the double-stranded region is 17-23 nucleotide pairs in length. In another embodiment, the double-stranded region is 17-25 nucleotide pairs in length. In another embodiment, the double-stranded region is 23-27 nucleotide pairs in length. In yet another embodiment, the double-stranded region is 19-21 nucleotide pairs in length. In another embodiment, the double-stranded region is 21-23 nucleotide pairs in length.

In one embodiment, each strand has 15-30 nucleotides.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and combinations thereof.

In one embodiment, the modifications on the nucleotides are 2'-O-methyl or 2'-fluoro modifications.

In one embodiment, the ligand is one or more GalNAc derivatives attached through a bivalent or trivalent branched linker.

In one embodiment, the ligand is

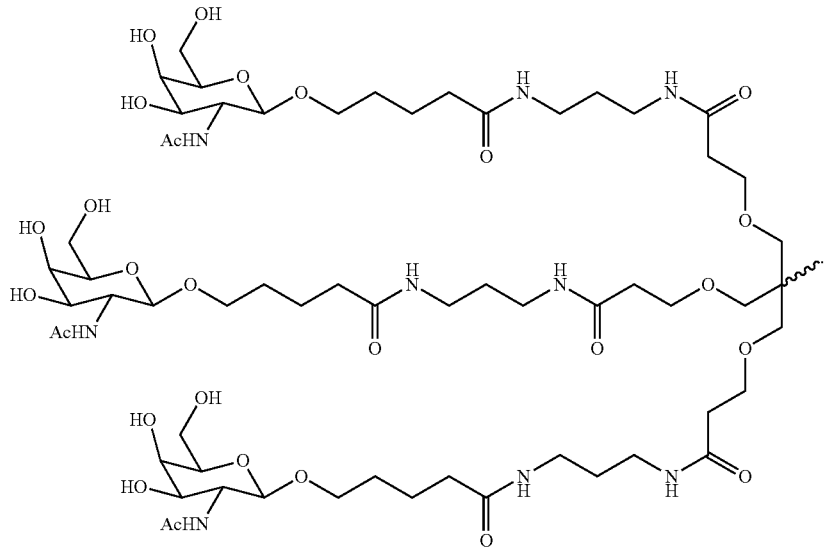 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the ligand is attached to the 3' end of the sense strand.

In one embodiment, the RNAi agent is conjugated to the ligand as shown in the following schematic

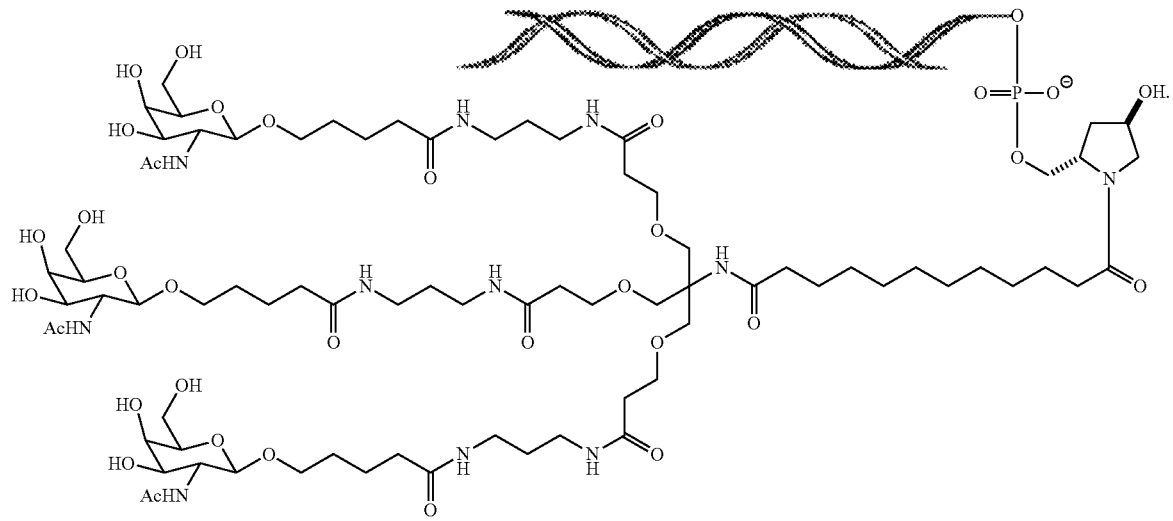

In one embodiment, the agent further comprises at least one phosphorothioate or methylphosphonate internucleotide linkage.

In one embodiment, the phosphorothioate or methylphosphonate internucleotide linkage is at the 3'-terminus of one strand.

In one embodiment, the strand is the antisense strand. In another embodiment, the strand is the sense strand.

In one embodiment, the phosphorothioate or methylphosphonate internucleotide linkage is at the 5'-terminus of one strand.

In one embodiment, the strand is the antisense strand. In another embodiment, the strand is the sense strand.

In one embodiment, the phosphorothioate or methylphosphonate internucleotide linkage is at the both the 5'- and 3'-terminus of one strand.

In one embodiment, the strand is the antisense strand.

In one embodiment, the base pair at the 1 position of the 5'-end of the antisense strand of the duplex is an AU base pair.

In one embodiment, the Y nucleotides contain a 2'-fluoro modification.

In one embodiment, the Y' nucleotides contain a 2'-O-methyl modification.

In one embodiment, p'>0.

In one embodiment, p'=2.

In one embodiment, q'=0, p=0, q=0, and p' overhang nucleotides are complementary to the target mRNA.

In one embodiment, q'=0, p=0, q=0, and p' overhang nucleotides are non-complementary to the target mRNA.

In one embodiment, the sense strand has a total of 21 nucleotides and the antisense strand has a total of 23 nucleotides.

In one embodiment, at least one $n_p'$ is linked to a neighboring nucleotide via a phosphorothioate linkage.

In one embodiment, all $n_p'$ are linked to neighboring nucleotides via phosphorothioate linkages.

In one embodiment, the RNAi agent is selected from the group of RNAi agents listed in Table 4, Table 18, Table 19, or Table 23. In another embodiment, the RNAi agent is selected from the group consisting of AD-58123, AD-58111, AD-58121, AD-58116, AD-58133, AD-58099, AD-58088, AD-58642, AD-58644, AD-58641, AD-58647, AD-58645, AD-58643, AD-58646, AD-62510, AD-62643, AD-62645, AD-62646, AD-62650, and AD-62651.

In one aspect, the present invention provides a double stranded RNAi agent capable of inhibiting the expression of complement component C5 in a cell, wherein said double stranded RNAi agent comprises a sense strand complementary to an antisense strand, wherein said antisense strand comprises a region complementary to part of an mRNA encoding complement component C5, wherein each strand is about 14 to about 30 nucleotides in length, wherein said double stranded RNAi agent is represented by formula (III):

```
sense:                                              (III)
5' n_p-N_a-(X X X)_i-N_b-Y Y Y-N_b-(Z Z Z)_j-N_a-n_q 3'
antisense:
3' n_p'-N_a'-(X'X'X')_k-N_b'-Y'Y'Y'-N_b'-(Z'Z'Z')_l-
N_a'-
n_q' 5'
``` wherein:
i, j, k, and l are each independently 0 or 1;
p, p', q, and q' are each independently 0-6;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
each $n_p$, $n_p'$, $n_q$, and $n_q'$, each of which may or may not be present independently represents an overhang nucleotide;
XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;
modifications on $N_b$ differ from the modification on Y and modifications on $N_b'$ differ from the modification on Y'; and wherein the sense strand is conjugated to at least one ligand.

In another aspect, the present invention provides a double stranded RNAi agent capable of inhibiting the expression of complement component C5 in a cell, wherein said double stranded RNAi agent comprises a sense strand complementary to an antisense strand, wherein said antisense strand comprises a region complementary to part of an mRNA encoding complement component C5, wherein each strand is about 14 to about 30 nucleotides in length, wherein said double stranded RNAi agent is represented by formula (III):

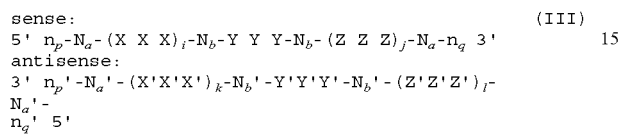

wherein:
i, j, k, and l are each independently 0 or 1;
each $n_p$, $n_q$, and $n_q'$, each of which may or may not be present, independently represents an overhang nucleotide;
p, q, and q' are each independently 0-6;
$n_p'>0$ and at least one $n_p'$ is linked to a neighboring nucleotide via a phosphorothioate linkage;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;
modifications on $N_b$ differ from the modification on Y and modifications on $N_b'$ differ from the modification on Y'; and
wherein the sense strand is conjugated to at least one ligand.

In another aspect, the present invention provides a double stranded RNAi agent capable of inhibiting the expression of complement component C5 in a cell, wherein said double stranded RNAi agent comprises a sense strand complementary to an antisense strand, wherein said antisense strand comprises a region complementary to part of an mRNA encoding complement component C5, wherein each strand is about 14 to about 30 nucleotides in length, wherein said double stranded RNAi agent is represented by formula (III):

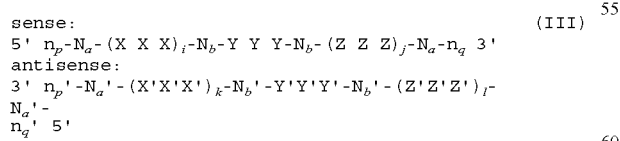

wherein:
i, j, k, and l are each independently 0 or 1;
each $n_p$, $n_q$, and $n_q'$, each of which may or may not be present, independently represents an overhang nucleotide;
p, q, and q' are each independently 0-6;
$n_p'>0$ and at least one $n_p'$ is linked to a neighboring nucleotide via a phosphorothioate linkage;

each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;
modifications on $N_b$ differ from the modification on Y and modifications on $N_b'$ differ from the modification on Y'; and
wherein the sense strand is conjugated to at least one ligand, wherein the ligand is one or more GalNAc derivatives attached through a bivalent or trivalent branched linker.

In yet another aspect, the present invention provides a double stranded RNAi agent capable of inhibiting the expression of complement component C5 in a cell, wherein said double stranded RNAi agent comprises a sense strand complementary to an antisense strand, wherein said antisense strand comprises a region complementary to part of an mRNA encoding complement component C5, wherein each strand is about 14 to about 30 nucleotides in length, wherein said double stranded RNAi agent is represented by formula (III):

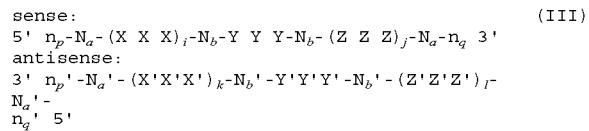

wherein:
i, j, k, and l are each independently 0 or 1;
each $n_p$, $n_q$, and $n_q'$, each of which may or may not be present, independently represents an overhang nucleotide;
p, q, and q' are each independently 0-6;
$n_p'>0$ and at least one $n_p'$ is linked to a neighboring nucleotide via a phosphorothioate linkage;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
XXX, YYY, ZZZ, X'X'X', Y'Y'Y', and Z'Z'Z' each independently represent one motif of three identical modifications on three consecutive nucleotides, and wherein the modifications are 2'-O-methyl or 2'-fluoro modifications;
modifications on $N_b$ differ from the modification on Y and modifications on $N_b'$ differ from the modification on Y';
wherein the sense strand comprises at least one phosphorothioate linkage; and
wherein the sense strand is conjugated to at least one ligand, wherein the ligand is one or more GalNAc derivatives attached through a bivalent or trivalent branched linker.

In another aspect, the present invention provides a double stranded RNAi agent capable of inhibiting the expression of complement component C5 in a cell, wherein said double stranded RNAi agent comprises a sense strand complementary to an antisense strand, wherein said antisense strand comprises a region complementary to part of an mRNA encoding complement component C5, wherein each strand is about 14 to about 30 nucleotides in length, wherein said double stranded RNAi agent is represented by formula (III):

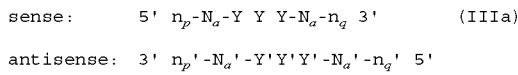

wherein:
each $n_p$, $n_q$, and $n_q'$, each of which may or may not be present, independently represents an overhang nucleotide;
p, q, and q' are each independently 0-6;
$n_p'>0$ and at least one $n_p'$ is linked to a neighboring nucleotide via a phosphorothioate linkage;
each $N_a$ and $N_a'$ independently represents an oligonucleotide sequence comprising 0-25 nucleotides which are either modified or unmodified or combinations thereof, each sequence comprising at least two differently modified nucleotides;
YYY and Y'Y'Y' each independently represent one motif of three identical modifications on three consecutive nucleotides, and wherein the modifications are 2'-O-methyl or 2'-fluoro modifications;
wherein the sense strand comprises at least one phosphorothioate linkage; and
wherein the sense strand is conjugated to at least one ligand, wherein the ligand is one or more GalNAc derivatives attached through a bivalent or trivalent branched linker.

In one aspect, the present invention provides a double stranded RNAi agent for inhibiting expression of complement component C5, wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, wherein substantially all of the nucleotides of the sense strand comprise a modification selected from the group consisting of a 2'-O-methyl modification and a 2'-fluoro modification, wherein the sense strand comprises two phosphorothioate internucleotide linkages at the 5'-terminus, wherein substantially all of the nucleotides of the antisense strand comprise a modification selected from the group consisting of a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a branched bivalent or trivalent linker at the 3'-terminus.

In one embodiment, all of the nucleotides of the sense strand and all of the nucleotides of the antisense strand are modified nucleotides. In another embodiment, each strand has 19-30 nucleotides.

In one aspect, the present invention provides a cell containing a dsRNA agent of the invention.

In one aspect, the present invention provides a vector encoding at least one strand of a dsRNA agent, wherein the dsRNA agent comprises a region of complementarity to at least a part of an mRNA encoding complement component C5, wherein the dsRNA is 30 base pairs or less in length, and wherein the dsRNA agent targets the mRNA for cleavage.

In one embodiment, the region of complementarity is at least 15 nucleotides in length. In another embodiment, the region of complementarity is 19 to 21 nucleotides in length. In another embodiment, each strand has 19-30 nucleotides.

In one aspect, the present invention provides a cell comprising a vector of the invention.

In one aspect, the present invention provides a pharmaceutical composition for inhibiting expression of a complement component C5 gene comprising a dsRNA agent of the invention.

In one embodiment, the RNAi agent is administered in an unbuffered solution.

In one embodiment, the unbuffered solution is saline or water.

In one embodiment, the RNAi agent is administered with a buffer solution.

In one embodiment, the buffer solution comprises acetate, citrate, prolamine, carbonate, or phosphate or any combination thereof.

In another embodiment, the buffer solution is phosphate buffered saline (PBS).

In another aspect, the present invention provides a pharmaceutical composition comprising a double stranded RNAi agent of the invention and a lipid formulation.

In one embodiment, the lipid formulation comprises a LNP. In another embodiment, the lipid formulation comprises a MC3.

In one aspect, the present invention provides a composition comprising an antisense polynucleotide agent selected from the group consisting of the sequences listed in any one of Tables 3, 4, 5, 6, 19, 18, 20, 21, and 23.

In another aspect, the present invention provides a composition comprising a sense polynucleotide agent selected from the group consisting of the sequences listed in any one of Tables 3, 4, 5, 6, 19, 18, 20, 21, and 23.

In yet another aspect, the present invention provides a modified antisense polynucleotide agent selected from the group consisting of the antisense sequences listed in any one of Tables 4, 6, 18, 19, 21, and 23.

In a further aspect, the present invention provides a modified sense polynucleotide agent selected from the group consisting of the sense sequences listed in any one of Tables 4, 6, 18, 19, 21, and 23.

In one aspect the present invention provides methods of treating a subject having a disease or disorder that would benefit from reduction in complement component C5 expression. The methods include administering to the subject a therapeutically effective amount of a dsRNA agent comprising a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, thereby treating the subject.

In another aspect, the present invention provides methods of preventing at least one symptom in a subject having a disease or disorder that would benefit from reduction in complement component C5 expression. The methods include administering to the subject a therapeutically effective amount of a dsRNA agent comprising a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, thereby preventing at least one symptom in the subject having a disorder that would benefit from reduction in C5 expression.

In another aspect, the present invention provides methods of treating a subject having a disease or disorder that would benefit from reduction in complement component C5 expression. The methods include administering to the subject a therapeutically effective amount of a dsRNA agent comprising a sense strand and an antisense strand, the antisense strand comprising a region of complementarity which comprises at least 15 contiguous nucleotides differing by no more than 3 nucleotides from any one of the antisense sequences listed in any one of Tables 3, 4, 5, 6, 18, 19, 20, 21, 23, thereby treating the subject.

In yet another aspect, the present invention provides methods of preventing at least one symptom in a subject having a disease or disorder that would benefit from reduction in complement component C5 expression. The methods include administering to the subject a prophylactically effective amount of a dsRNA agent comprising a sense strand and an antisense strand, the antisense strand comprising a region of complementarity which comprises at least 15 contiguous nucleotides differing by no more than 3 nucleotides from any one of the antisense sequences listed in any one of Tables 3, 4, 5, 6, 18, 19, 20, 21, and 23, thereby preventing at least one symptom in the subject having a disorder that would benefit from reduction in C5 expression.

In one aspect, the present invention provides methods of treating a subject having a disease or disorder that would benefit from reduction in complement component C5 expression which include administering to the subject a therapeutically effective amount of a double stranded RNAi agent, wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, wherein substantially all of the nucleotides of the antisense strand and substantially all of the nucleotides of the sense strand are modified nucleotides and, wherein the sense strand is conjugated to one or more ligands at the 3'-terminus.

In one embodiment, all of the nucleotides of the sense strand and all of the nucleotides of the antisense strand are modified nucleotides.

In one embodiment, the administration is subcutaneous administration.

In one embodiment, substantially all of the nucleotides of the sense strand are modified nucleotides selected from the group consisting of a 2'-O-methyl modification, a 2'-fluoro modification and a 3'-terminal dT nucleotide. In another embodiment, substantially all of the nucleotides of the antisense strand are modified nucleotides selected from the group consisting of a 2'-O-methyl modification, a 2'-fluoro modification and a 3'-terminal dT nucleotide. In another embodiment, the modified nucleotides are a short sequence of deoxythymine (dT) nucleotides. In another embodiment, the sense strand comprises two phosphorothioate internucleotide linkages at the 5'-terminus. In one embodiment, the antisense strand comprises two phosphorothioate internucleotide linkages at the 5'-terminus and two phosphorothioate internucleotide linkages at the 3'-terminus. In yet another embodiment, the sense strand is conjugated to one or more GalNAc derivatives attached through a branched bivalent or trivalent linker at the 3'-terminus.

In another aspect, the present invention provides methods of preventing at least one symptom in a subject having a disease or disorder that would benefit from reduction in complement component C5 expression which include administering to the subject a prophylactically effective amount of a double stranded RNAi agent, wherein the double stranded RNAi agent comprises a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, wherein substantially all of the nucleotides of the antisense strand and substantially all of the nucleotides of the sense strand are modified nucleotides and, wherein the sense strand is conjugated to a ligand at the 3'-terminus.

In one embodiment, all of the nucleotides of the sense strand and all of the nucleotides of the antisense strand are modified nucleotides.

In one embodiment, the administration is subcutaneous administration.

In one embodiment, substantially all of the nucleotides of the sense strand are modified nucleotides selected from the group consisting of a 2'-O-methyl modification, a 2'-fluoro modification and a 3'-terminal dT nucleotide. In another embodiment, substantially all of the nucleotides of the antisense strand are modified nucleotides selected from the group consisting of a 2'-O-methyl modification, a 2'-fluoro modification and a 3'-terminal dT nucleotide. In another embodiment, the modified nucleotides are a short sequence of deoxythymine (dT) nucleotides. In another embodiment, the sense strand comprises two phosphorothioate internucleotide linkages at the 5'-terminus. In one embodiment, the antisense strand comprises two phosphorothioate internucleotide linkages at the 5'-terminus and two phosphorothioate internucleotide linkages at the 3'-terminus. In yet another embodiment, the sense strand is conjugated to one or more GalNAc derivatives attached through a branched bivalent or trivalent linker at the 3'-terminus.

In one aspect, the present invention provides methods of treating a subject having a disease or disorder that would benefit from reduction in complement component C5 expression. The methods include administering to the subject a therapeutically effective amount of a dsRNA agent comprising a sense strand complementary to an antisense strand, wherein the antisense strand comprises a region complementary to part of an mRNA encoding C5, wherein each strand is about 14 to about 30 nucleotides in length, wherein the double stranded RNAi agent is represented by formula (III):

```
sense:                                              (III)
5' n_p-N_a-(X X X)_i-N_b-Y Y Y-N_b-(Z Z Z)_j-N_a-n_q 3'
antisense:
3' n_p'-N_a'-(X'X'X')_k-N_b'-Y'Y'Y'-N_b'-(Z'Z'Z')_l-
N_a'-
n_q' 5'
``` wherein:
i, j, k, and l are each independently 0 or 1;
p, p', q, and q' are each independently 0-6;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof;

each $n_p$, $n_p'$, $n_q$, and $n_q'$, each of which may or may not be present, independently represents an overhang nucleotide;

XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b'$ differ from the modification on Y'; and wherein the sense strand is conjugated to at least one ligand, thereby treating the subject, thereby treating a subject having a disease or disorder that would benefit from reduction in complement component C5 expression.

In another aspect, the present invention provides methods of preventing at least one symptom in a subject having a disease or disorder that would benefit from reduction in complement component C5 expression. The methods include administering to the subject a prophylactically effective amount of a dsRNA agent comprising a sense strand complementary to an antisense strand, wherein the antisense strand comprises a region complementary to part of an mRNA encoding C5, wherein each strand is about 14 to about 30 nucleotides in length, wherein the double stranded RNAi agent is represented by formula (III):

```
sense:                                                    (III)
5' n_p-N_a-(X X X)_i-N_b-Y Y Y-N_b-(Z Z Z)_j-N_a-n_q 3'
antisense:
3' n_p'-N_a'-(X'X'X')_k-N_b'-Y'Y'Y'-N_b'-(Z'Z'Z')_l-
N_a'-
n_q' 5'
``` wherein:

i, j, k, and l are each independently 0 or 1;

p, p', q, and q' are each independently 0-6;

each $N_a$ and $N_a'$ independently represents an oligonucleotide sequence comprising 0-25 nucleotides which are either modified or unmodified or combinations thereof, each sequence comprising at least two differently modified nucleotides;

each $N_b$ and $N_b'$ independently represents an oligonucleotide sequence comprising 0-10 nucleotides which are either modified or unmodified or combinations thereof;

each $n_p$, $n_p'$, $n_q$, and $n_q'$, each of which may or may not be present, independently represents an overhang nucleotide;

XXX, YYY, ZZZ, X'X'X', Y'Y'Y', and Z'Z'Z' each independently represent one motif of three identical modifications on three consecutive nucleotides;

modifications on $N_b$ differ from the modification on Y and modifications on $N_b'$ differ from the modification on Y'; and wherein the sense strand is conjugated to at least one ligand, thereby preventing at least one symptom in the subject having a disorder that would benefit from reduction in C5 expression, thereby preventing at least one symptom in a subject having a disease or disorder that would benefit from reduction in complement component C5 expression.

In one embodiment, the administration of the dsRNA to the subject causes a decrease in intravascular hemolysis, a stabilization of hemoglobin levels and/or a decrease in C5 protein accumulation.

In one embodiment, the disorder is a complement component C5-associated disease. In one embodiment, the complement component C5-associated disease is selected from the group consisting of paroxysmal nocturnal hemoglobinuria (PNH), atypical hemolytic uremic syndrome (aHUS), asthma, rheumatoid arthritis (RA); antiphospholipid antibody syndrome; lupus nephritis; ischemia-reperfusion injury; typical or infectious hemolytic uremic syndrome (tHUS); dense deposit disease (DDD); neuromyelitis optica (NMO); multifocal motor neuropathy (MMN); multiple sclerosis (MS); macular degeneration (e.g., age-related macular degeneration (AMD)); hemolysis, elevated liver enzymes, and low platelets (HELLP) syndrome; thrombotic thrombocytopenic purpura (TTP); spontaneous fetal loss; Pauci-immune vasculitis; epidermolysis bullosa; recurrent fetal loss; pre-eclampsia, traumatic brain injury, myasthenia gravis, cold agglutinin disease, dermatomyositis bullous pemphigoid, Shiga toxin E. coli-related hemolytic uremic syndrome, C3 nephropathy, anti-neutrophil cytoplasmic antibody-associated vasculitis, humoral and vascular transplant rejection, graft dysfunction, myocardial infarction, an allogenic transplant, sepsis, Coronary artery disease, dermatomyositis, Graves' disease, atherosclerosis, Alzheimer's disease, systemic inflammatory response sepsis, septic shock, spinal cord injury, glomerulonephritis, Hashimoto's thyroiditis, type I diabetes, psoriasis, pemphigus, autoimmune hemolytic anemia (AIHA), ITP, Goodpasture syndrome, Degos disease, antiphospholipid syndrome (APS), catastrophic APS (CAPS), a cardiovascular disorder, myocarditis, a cerebrovascular disorder, a peripheral vascular disorder, a renovascular disorder, a mesenteric/enteric vascular disorder, vasculitis, Henoch-Schönlein purpura nephritis, systemic lupus erythematosus-associated vasculitis, vasculitis associated with rheumatoid arthritis, immune complex vasculitis, Takayasu's disease, dilated cardiomyopathy, diabetic angiopathy, Kawasaki's disease (arteritis), venous gas embolus (VGE), and restenosis following stent placement, rotational atherectomy, membraneous nephropathy, Guillain-Barre syndrome, and percutaneous transluminal coronary angioplasty (PTCA). In another embodiment, the complement component C5-associated disease is paroxysmal nocturnal hemoglobinuria (PNH). In yet another embodiment, the complement component C5-associated disease is atypical hemolytic uremic syndrome (aHUS).

In one embodiment, the subject is human.

In another embodiment, the methods of the invention further include administering an anti-complement component C5 antibody, or antigen-binding fragment thereof, to the subject.

In one embodiment, the antibody, or antigen-binding fragment thereof, inhibits cleavage of complement component C5 into fragments C5a and C5b. In another embodiment, the anti-complement component C5 antibody is eculizumab.

In another embodiment, the methods of the invention further include administering a meningococcal vaccine to the subject.

In one embodiment, eculizumab is administered to the subject weekly at a dose less than about 600 mg for 4 weeks followed by a fifth dose at about one week later of less than about 900 mg, followed by a dose less than about 900 mg about every two weeks thereafter.

In another embodiment, eculizumab is administered to the subject weekly at a dose less than about 900 mg for 4 weeks followed by a fifth dose at about one week later of less than about 1200 mg, followed by a dose less than about 1200 mg about every two weeks thereafter.

In one embodiment, the subject is less than 18 years of age and eculizumab is administered to the subject weekly at a dose less than about 900 mg for 4 weeks followed by a fifth dose at about one week later of less than about 1200 mg, followed by a dose less than about 1200 mg about every two weeks thereafter.

In another embodiment, the subject is less than 18 years of age and eculizumab is administered to the subject weekly at a dose less than about 600 mg for 2 weeks followed by a third dose at about one week later of less than about 900 mg, followed by a dose less than about 900 mg about every two weeks thereafter.

In another embodiment, the subject is less than 18 years of age and eculizumab is administered to the subject weekly at a dose less than about 600 mg for 2 weeks followed by a third dose at about one week later of less than about 600 mg, followed by a dose less than about 600 mg about every two weeks thereafter.

In yet another embodiment, the subject is less than 18 years of age and eculizumab is administered to the subject weekly at a dose less than about 600 mg for 1 week followed by a second dose at about one week later of less than about 300 mg, followed by a dose less than about 300 mg about every two weeks thereafter.

In one embodiment, the subject is less than 18 years of age and eculizumab is administered to the subject weekly at a dose less than about 300 mg for 1 week followed by a second dose at about one week later of less than about 300 mg, followed by a dose less than about 300 mg about every two weeks thereafter.

In another embodiment, the methods of the invention further include plasmapheresis or plasma exchange in the subject. In one such embodiment, eculizumab is administered to the subject at a dose less than about 600 mg or at a dose less than about 300 mg.

In a further embodiment, the methods of the invention further include plasma infusion in the subject. In one such embodiment, eculizumab is administered to the subject at a dose less than about 300 mg.

In one embodiment, eculizumab is administered to the subject at a dose of about 0.01 mg/kg to about 10 mg/kg or about 0.5 mg/kg to about 15 mg/kg. In another embodiment, eculizumab is administered to the subject at a dose of about 5 mg/kg to about 15 mg/kg.

In one embodiment, eculizumab is administered to the subject at a dose selected from the group consisting of 0.5 mg/kg, 1 mg/kg, 1.5 mg/kg, 3 mg/kg, 5 mg/kg, 7 mg/kg, 10 mg/kg, and 15 mg/kg.

In one embodiment, eculizumab is administered to the subject via an intravenous infusion.

In another embodiment, eculizumab is administered to the subject subcutaneously.

In one embodiment, the dsRNA agent is administered at a dose of about 0.01 mg/kg to about 10 mg/kg or about 0.5 mg/kg to about 50 mg/kg.

In another embodiment, dsRNA agent is administered at a dose of about 10 mg/kg to about 30 mg/kg.

In one embodiment, the dsRNA agent is administered at a dose selected from the group consisting of 0.5 mg/kg 1 mg/kg, 1.5 mg/kg, 3 mg/kg, 5 mg/kg, 10 mg/kg, and 30 mg/kg.

In one embodiment, the dsRNA agent is administered to the subject once a week. In another embodiment, the dsRNA agent is administered to the subject twice a week. In another embodiment, the dsRNA agent is administered to the subject twice a month.

In one embodiment, the dsRNA agent is administered to the subject subcutaneously.

In one embodiment, the dsRNA agent and the eculizumab are administered to the subject subcutaneously. In another embodiment, the dsRNA agent and the eculizumab are administered to the subject simultaneously.

In one embodiment, the dsRNA agent is administered to the subject first for a period of time sufficient to reduce the levels of complement component C5 in the subject, and eculizumab is administered subsequently at a dose less than about 600 mg.

In one embodiment, the levels of complement component C5 in the subject are reduced by at least about 30%, 35%, 40%, 45%, 50%, 55%, 60%, 65%, 70%, 75%, 80%, 85%, or 90%.

In one embodiment, eculizumab is administered at a dose of about 100-500 mg.

In one embodiment, the methods of the invention further include measuring hemoglobin and/or LDH levels in the subject.

In one embodiment, the dsRNA is conjugated to a ligand.

In one embodiment, the ligand is conjugated to the 3'-end of the sense strand of the dsRNA.

In one embodiment, the ligand is an N-acetylgalactosamine (GalNAc) derivative.

In one aspect, the present invention provides methods of inhibiting complement component C5 expression in a cell. The methods include contacting the cell with a dsRNA agent comprising a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5; and maintaining the cell produced in step (a) for a time sufficient to obtain degradation of the mRNA transcript of a C5 gene, thereby inhibiting expression of the C5 gene in the cell.

In another aspect, the present invention provides methods of inhibiting complement component C5 expression in a cell. The methods include contacting the cell with a dsRNA agent comprising a sense strand and an antisense strand, the antisense strand comprising a region of complementarity which comprises at least 15 contiguous nucleotides differing by no more than 3 nucleotides from any one of the antisense sequences listed in any one of Tables 3, 4, 5, 6, 18, 19, 20, 21, and 23; and maintaining the cell produced in step (a) for a time sufficient to obtain degradation of the mRNA transcript of a C5 gene, thereby inhibiting expression of the C5 gene in the cell.

In another aspect, the present invention provides methods of inhibiting complement component C5 expression in a cell, which includes contacting the cell with a dsRNA agent comprising a sense strand and an antisense strand comprising a region of complementarity, the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, wherein substantially all of the nucleotides of the antisense strand and substantially all of the nucleotides of the sense strand are modified nucleotides and, wherein the sense strand is conjugated to one or more ligands at the 3'-terminus; and maintaining the cell produced in the first step for a time sufficient to obtain degradation of the mRNA transcript of a C5 gene, thereby inhibiting expression of the C5 gene in the cell.

In one embodiment, all of the nucleotides of the sense strand and all of the nucleotides of the antisense strand are modified nucleotides.

In one embodiment, substantially all of the nucleotides of the sense strand are modified nucleotides selected from the group consisting of a 2'-O-methyl modification, a 2'-fluoro modification and a 3'-terminal dT nucleotide. In another embodiment, substantially all of the nucleotides of the antisense strand are modified nucleotides selected from the group consisting of a 2'-O-methyl modification, a 2'-fluoro modification and a 3'-terminal dT nucleotide. In another embodiment, the modified nucleotides are a short sequence of deoxythymine (dT) nucleotides. In another embodiment, the sense strand comprises two phosphorothioate internucleotide linkages at the 5'-terminus. In one embodiment, the antisense strand comprises two phosphorothioate internucleotide linkages at the 5'-terminus and two phosphorothioate internucleotide linkages at the 3'-terminus. In yet another embodiment, the sense strand is conjugated to one or more GalNAc derivatives attached through a branched bivalent or trivalent linker at the 3'-terminus.

In yet another aspect, the present invention provides methods of inhibiting complement component C5 expression in a cell. The methods include contacting the cell with a dsRNA agent comprising a sense strand complementary to an antisense strand, wherein the antisense strand comprises a region complementary to part of an mRNA encoding C5, wherein each strand is about 14 to about 30 nucleotides in length, wherein the double stranded RNAi agent is represented by formula (III):

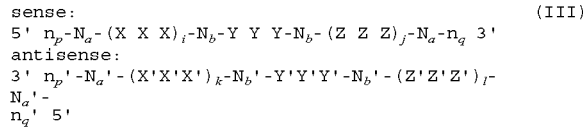

wherein:
i, j, k, and l are each independently 0 or 1;
p, p', q, and q' are each independently 0-6;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
each $n_p$, $n_p'$, $n_q$, and $n_q'$, each of which may or may not be present, independently represents an overhang nucleotide;
XXX, YYY, ZZZ, X'X'X', Y'Y'Y', and Z'Z'Z' each independently represent one motif of three identical modifications on three consecutive nucleotides;
modifications on $N_b$ differ from the modification on Y and modifications on $N_b'$ differ from the modification on Y'; and wherein the sense strand is conjugated to at least one ligand; and maintaining the cell produced in step (a) for a time sufficient to obtain degradation of the mRNA transcript of a C5 gene, thereby inhibiting expression of the C5 gene in the cell.

In one embodiment, the cell is within a subject.
In one embodiment, the subject is a human.
In one embodiment, the human subject suffers from a complement component C5-associated disease.
In one embodiment, the complement component C5-associated disease is selected from the group consisting of paroxysmal nocturnal hemoglobinuria (PNH), atypical hemolytic uremic syndrome (aHUS), asthma, rheumatoid arthritis (RA); antiphospholipid antibody syndrome; lupus nephritis; ischemia-reperfusion injury; typical or infectious hemolytic uremic syndrome (tHUS); dense deposit disease (DDD); neuromyelitis optica (NMO); multifocal motor neuropathy (MMN); multiple sclerosis (MS); macular degeneration (e.g., age-related macular degeneration (AMD)); hemolysis, elevated liver enzymes, and low platelets (HELLP) syndrome; thrombotic thrombocytopenic purpura (TTP); spontaneous fetal loss; Pauci-immune vasculitis; epidermolysis bullosa; recurrent fetal loss; pre-eclampsia, traumatic brain injury, myasthenia gravis, cold agglutinin disease, dermatomyositis bullous pemphigoid, Shiga toxin E. coli-related hemolytic uremic syndrome, C3 nephropathy, anti-neutrophil cytoplasmic antibody-associated vasculitis, humoral and vascular transplant rejection, graft dysfunction, myocardial infarction, an allogenic transplant, sepsis, Coronary artery disease, dermatomyositis, Graves' disease, atherosclerosis, Alzheimer's disease, systemic inflammatory response sepsis, septic shock, spinal cord injury, glomerulonephritis, Hashimoto's thyroiditis, type I diabetes, psoriasis, pemphigus, autoimmune hemolytic anemia (AIHA), ITP, Goodpasture syndrome, Degos disease, antiphospholipid syndrome (APS), catastrophic APS (CAPS), a cardiovascular disorder, myocarditis, a cerebrovascular disorder, a peripheral vascular disorder, a renovascular disorder, a mesenteric/enteric vascular disorder, vasculitis, Henoch-Schönlein purpura nephritis, systemic lupus erythematosus-associated vasculitis, vasculitis associated with rheumatoid arthritis, immune complex vasculitis, Takayasu's disease, dilated cardiomyopathy, diabetic angiopathy, Kawasaki's disease (arteritis), venous gas embolus (VGE), and restenosis following stent placement, rotational atherectomy, membraneous nephropathy, Guillain-Barre syndrome, and percutaneous transluminal coronary angioplasty (PTCA). In another embodiment, the complement component C5-associated disease is paroxysmal nocturnal hemoglobinuria (PNH). In another embodiment, the complement component C5-associated disease is atypical hemolytic uremic syndrome (aHUS).

In one embodiment, the methods further include contacting the cell with an anti-complement component C5 antibody, or antigen-binding fragment thereof.

In one embodiment, the antibody, or antigen-binding fragment thereof, inhibits cleavage of complement component C5 into fragments C5a and C5b.

In one embodiment, the anti-complement component C5 antibody, or antigen-binding fragment thereof, is eculizumab.

In one embodiment, the methods further include contacting the cell with a meningococcal vaccine.

In one embodiment, the cell is contacted with eculizumab weekly at a dose less than about 600 mg for 4 weeks followed by a fifth dose at about one week later of less than about 900 mg, followed by a dose less than about 900 mg about every two weeks thereafter.

In another embodiment, the cell is contacted with eculizumab weekly at a dose less than about 900 mg for 4 weeks followed by a fifth dose at about one week later of less than about 1200 mg, followed by a dose less than about 1200 mg about every two weeks thereafter.

In another embodiment, the cell is contacted with eculizumab weekly at a dose less than about 900 mg for 4 weeks followed by a fifth dose at about one week later of less than about 1200 mg, followed by a dose less than about 1200 mg about every two weeks thereafter.

In yet another embodiment, the cell is contacted with eculizumab weekly at a dose less than about 600 mg for 2 weeks followed by a third dose at about one week later of less than about 900 mg, followed by a dose less than about 900 mg about every two weeks thereafter.

In one embodiment, the cell is contacted with eculizumab weekly at a dose less than about 600 mg for 2 weeks followed by a third dose at about one week later of less than about 600 mg, followed by a dose less than about 600 mg about every two weeks thereafter.

In another embodiment, the cell is contacted with eculizumab weekly at a dose less than about 600 mg for 1 week followed by a second dose at about one week later of less than about 300 mg, followed by a dose less than about 300 mg about every two weeks thereafter.

In one embodiment, the cell is contacted with eculizumab weekly at a dose less than about 300 mg for 1 week followed by a second dose at about one week later of less than about 300 mg, followed by a dose less than about 300 mg about every two weeks thereafter.

In one embodiment, the cell is within a subject.

In one embodiment, the methods of the invention further include plasmapheresis or plasma exchange in the subject. In one embodiment, eculizumab is administered to the subject at a dose less than about 600 mg. In another embodiment, eculizumab is administered to the subject at a dose less than about 300 mg.

In one embodiment, the methods of the invention further include plasma infusion in the subject. In one embodiment, eculizumab is administered to the subject at a dose less than about 300 mg.

In one embodiment, the cell is contacted with eculizumab at a dose of about 0.01 mg/kg to about 10 mg/kg or about 0.5 mg/kg to about 15 mg/kg.

In another embodiment, the cell is contacted with eculizumab at a dose of about 5 mg/kg to about 15 mg/kg.

In one embodiment, the cell is contacted with eculizumab at a dose selected from the group consisting of 0.5 mg/kg, 1 mg/kg, 1.5 mg/kg, 3 mg/kg, 5 mg/kg, 7 mg/kg, 10 mg/kg, and 15 mg/kg.

In one embodiment, eculizumab is administered to the subject via an intravenous infusion. In another embodiment, eculizumab is administered to the subject subcutaneously.

In one embodiment, the cell is contacted with the dsRNA agent at a dose of about 0.01 mg/kg to about 10 mg/kg or about 0.5 mg/kg to about 50 mg/kg.

In another embodiment, the cell is contacted with the dsRNA agent at a dose of about 10 mg/kg to about 30 mg/kg.

In one embodiment, the cell is contacted with the dsRNA agent at a dose selected from the group consisting of 0.5 mg/kg 1 mg/kg, 1.5 mg/kg, 3 mg/kg, 5 mg/kg, 10 mg/kg, and 30 mg/kg.

In one embodiment, the cell is contacted with the dsRNA agent once a week. In another embodiment, the dsRNA agent is administered to the subject twice a week. In another embodiment, the cell is contacted with the dsRNA agent twice a month.

In one embodiment, the dsRNA agent is administered to the subject subcutaneously.

In one embodiment, the dsRNA agent and the eculizumab are administered to the subject subcutaneously. In another embodiment, the dsRNA agent and the eculizumab are administered to the subject simultaneously.

In one embodiment, the cell is contacted with the dsRNA agent and the eculizumab simultaneously.

In one embodiment, the dsRNA agent is administered to the subject first for a period of time sufficient to reduce the levels of complement component C5 in the subject, and eculizumab is administered subsequently at a dose less than about 600 mg.

In one embodiment, the levels of complement component C5 in the subject are reduced by at least about 30%, 35%, 40%, 45%, 50%, 55%, 60%, 65%, 70%, 75%, 80%, 85%, or 90%.

In one embodiment, eculizumab is administered at a dose of about 100-500 mg.

In one embodiment, the cell is contacted with the dsRNA agent first for a period of time sufficient to reduce the levels of complement component C5 in the cell, and the cell is subsequently contacted with eculizumab at a dose less than about 600 mg.

In one embodiment, the levels of complement component C5 in the cell are reduced by at least about 30%, 35%, 40%, 45%, 50%, 55%, 60%, 65%, 70%, 75%, 80%, 85%, or 90%.

In one embodiment, the cell is contacted with eculizumab at a dose of about 100-500 mg.

In one aspect, the present invention provides methods of inhibiting the expression of C5 in a subject. The methods include administering to the subject a therapeutically effective amount of a dsRNA agent comprising a sense strand and an antisense strand, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, thereby inhibiting the expression of C5 in the subject.

In another aspect, the present invention provides methods of inhibiting the expression of C5 in a subject. The methods include administering to the subject a therapeutically effective amount of a dsRNA agent comprising a sense strand and an antisense strand, the antisense strand comprising a region of complementarity which comprises at least 15 contiguous nucleotides differing by no more than 3 nucleotides from any one of the antisense sequences listed in any one of Tables 3, 4, 5, 6, 18, 19, 20, 21, and 23, thereby inhibiting the expression of C5 in the subject.

In another aspect, the present invention provides methods of inhibiting complement component C5 expression in a subject which include administering to the subject a therapeutically effective amount of a dsRNA agent comprising a sense strand and an antisense strand forming a double stranded region, wherein the sense strand comprises at least 15 contiguous nucleotides differing by no more than 3 nucleotides from the nucleotide sequence of SEQ ID NO:1 and the antisense strand comprises at least 15 contiguous nucleotides differing by no more than 3 nucleotides from the nucleotide sequence of SEQ ID NO:5, wherein substantially all of the nucleotides of the antisense strand and substantially all of the nucleotides of the sense strand are modified nucleotides and, wherein the sense strand is conjugated to one or more ligands at the 3'-terminus, thereby inhibiting expression of the C5 gene in the subject.

In one embodiment, all of the nucleotides of the sense strand and all of the nucleotides of the antisense strand are modified nucleotides.

In one embodiment, the administration is subcutaneous administration.

In one embodiment, substantially all of the nucleotides of the sense strand are modified nucleotides selected from the group consisting of a 2'-O-methyl modification, a 2'-fluoro modification and a 3'-terminal dT nucleotide. In another embodiment, substantially all of the nucleotides of the antisense strand are modified nucleotides selected from the group consisting of a 2'-O-methyl modification, a 2'-fluoro modification and a 3'-terminal dT nucleotide. In another embodiment, the modified nucleotides are a short sequence of deoxythymine (dT) nucleotides. In another embodiment, the sense strand comprises two phosphorothioate internucleotide linkages at the 5'-terminus. In one embodiment, the antisense strand comprises two phosphorothioate internucleotide linkages at the 5'-terminus and two phosphorothioate internucleotide linkages at the 3'-terminus. In yet another embodiment, the sense strand is conjugated to one or more GalNAc derivatives attached through a branched bivalent or trivalent linker at the 3'-terminus.

In another aspect, the present invention provides methods of inhibiting the expression of C5 in a subject. The methods include administering to the subject a therapeutically effective amount of a dsRNA agent comprising a sense strand complementary to an antisense strand, wherein the antisense strand comprises a region complementary to part of an mRNA encoding C5, wherein each strand is about 14 to about 30 nucleotides in length, wherein the double stranded RNAi agent is represented by formula (III):

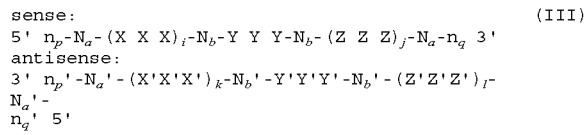

wherein:
i, j, k, and l are each independently 0 or 1;
p, p', q, and q' are each independently 0-6;
each $N_a$ and $N_a'$ independently represents an oligonucleotide sequence comprising 0-25 nucleotides which are either modified or unmodified or combinations thereof, each sequence comprising at least two differently modified nucleotides;
each $N_b$ and $N_b'$ independently represents an oligonucleotide sequence comprising 0-10 nucleotides which are either modified or unmodified or combinations thereof;
each $n_p$, $n_p'$, $n_q$, and $n_q'$, each of which may or may not be present, independently represents an overhang nucleotide;
XXX, YYY, ZZZ, X'X'X', Y'Y'Y', and Z'Z'Z' each independently represent one motif of three identical modifications on three consecutive nucleotides;
modifications on $N_b$ differ from the modification on Y and modifications on $N_b'$ differ from the modification on Y'; and
wherein the sense strand is conjugated to at least one ligand, thereby inhibiting the expression of C5 in the subject.

In one embodiment, the methods further include administration of an anti-complement component C5 antibody, or antigen-binding fragment thereof, to the subject.

In one embodiment, the anti-complement component C5 antibody, or antigen-binding fragment thereof, is eculizumab.

In one embodiment, the antibody, or antigen-binding fragment thereof, inhibits cleavage of complement component C5 into fragments C5a and C5b.

In one embodiment, the methods of the invention further include administering a meningococcal vaccine to the subject.

In one embodiment, eculizumab is administered to the subject weekly at a dose less than about 600 mg for 4 weeks followed by a fifth dose at about one week later of less than about 900 mg, followed by a dose less than about 900 mg about every two weeks thereafter.

In another embodiment, eculizumab is administered to the subject weekly at a dose less than about 900 mg for 4 weeks followed by a fifth dose at about one week later of less than about 1200 mg, followed by a dose less than about 1200 mg about every two weeks thereafter.

In one embodiment, the subject is less than 18 years of age and eculizumab is administered to the subject weekly at a dose less than about 900 mg for 4 weeks followed by a fifth dose at about one week later of less than about 1200 mg, followed by a dose less than about 1200 mg about every two weeks thereafter.

In another embodiment, the subject is less than 18 years of age and eculizumab is administered to the subject weekly at a dose less than about 600 mg for 2 weeks followed by a third dose at about one week later of less than about 900 mg, followed by a dose less than about 900 mg about every two weeks thereafter.

In one embodiment, the subject is less than 18 years of age and eculizumab is administered to the subject weekly at a dose less than about 600 mg for 2 weeks followed by a third dose at about one week later of less than about 600 mg, followed by a dose less than about 600 mg about every two weeks thereafter.

In another embodiment, the subject is less than 18 years of age and eculizumab is administered to the subject weekly at a dose less than about 600 mg for 1 week followed by a second dose at about one week later of less than about 300 mg, followed by a dose less than about 300 mg about every two weeks thereafter.

In yet another embodiment, the subject is less than 18 years of age and eculizumab is administered to the subject weekly at a dose less than about 300 mg for 1 week followed by a second dose at about one week later of less than about 300 mg, followed by a dose less than about 300 mg about every two weeks thereafter.

In one embodiment, the methods further include plasmapheresis or plasma exchange in the subject. In one embodiment, eculizumab is administered to the subject at a dose less than about 600 mg. In another embodiment, eculizumab is administered to the subject at a dose less than about 300 mg.

In one embodiment, the methods further include plasma infusion in the subject. In one embodiment, eculizumab is administered to the subject at a dose less than about 300 mg.

In one embodiment, eculizumab is administered to the subject at a dose of about 0.01 mg/kg to about 10 mg/kg or about 0.5 mg/kg to about 15 mg/kg. In another embodiment, eculizumab is administered to the subject at a dose of about 5 mg/kg to about 15 mg/kg.

In another embodiment, eculizumab is administered to the subject at a dose selected from the group consisting of 0.5 mg/kg, 1 mg/kg, 1.5 mg/kg, 3 mg/kg, 5 mg/kg, 7 mg/kg, 10 mg/kg, and 30 mg/kg.

In one embodiment, eculizumab is administered to the subject via an intravenous infusion. In another embodiment, eculizumab is administered to the subject subcutaneously.

In one embodiment, the dsRNA agent is administered at a dose of about 0.01 mg/kg to about 10 mg/kg or about 0.5 mg/kg to about 15 mg/kg.

In one embodiment, the dsRNA agent is administered at a dose of about 10 mg/kg to about 30 mg/kg. In another embodiment, the dsRNA agent is administered at a dose selected from the group consisting of 0.5 mg/kg 1 mg/kg, 1.5 mg/kg, 3 mg/kg, 5 mg/kg, 10 mg/kg, and 30 mg/kg.

In one embodiment, the dsRNA agent is administered to the subject once a week. In another embodiment, the dsRNA agent is administered to the subject twice a week. In another embodiment, the dsRNA agent is administered to the subject twice a month.

In one embodiment, the dsRNA agent is administered to the subject subcutaneously.

In one embodiment, the dsRNA agent and the eculizumab are administered to the subject subcutaneously. In another embodiment, the dsRNA agent and the eculizumab are administered to the subject simultaneously.

In one embodiment, the dsRNA agent is administered to the subject first for a period of time sufficient to reduce the levels of complement component C5 in the subject, and eculizumab is administered subsequently at a dose less than about 600 mg.

In one embodiment, the levels of complement component C5 in the subject are reduced by at least about 30%, 35%, 40%, 45%, 50%, 55%, 60%, 65%, 70%, 75%, 80%, 85%, or 90%.

In one embodiment, eculizumab is administered at a dose of about 100-500 mg.

In one embodiment, the dsRNA agent is conjugated to a ligand.

In one embodiment, the ligand is conjugated to the 3'-end of the sense strand of the dsRNA agent.

In one embodiment, the ligand is an N-acetylgalactosamine (GalNAc) derivative.

BRIEF DESCRIPTION OF THE DRAWINGS

Figure 18H:
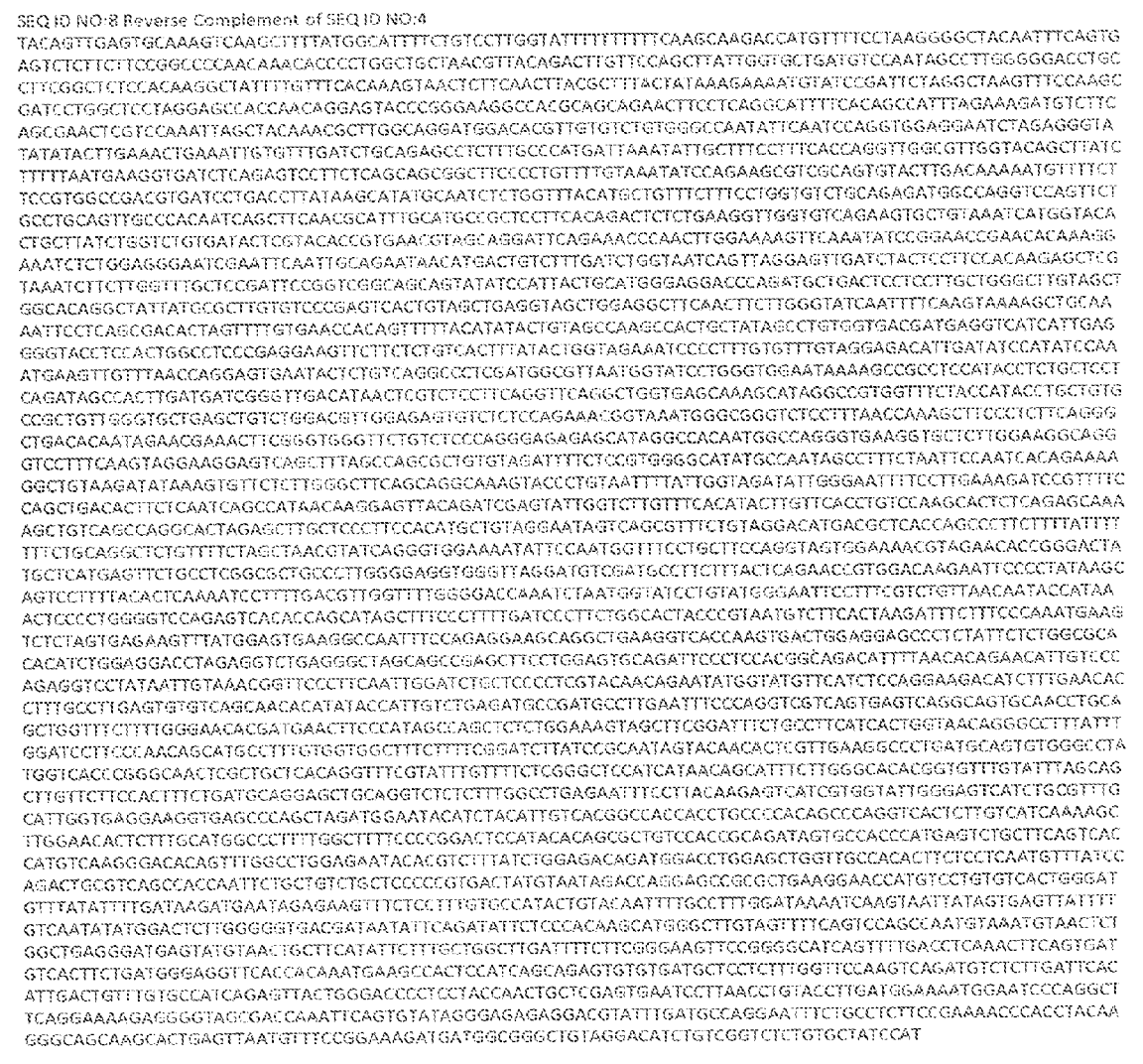

FIG. 18A shows the nucleotide sequence of Homo sapiens Complement Component 5 (C5) (SEQ ID NO:1); FIG. 18B shows the nucleotide sequence of *Macaca mulatta* Complement Component 5 (C5) (SEQ ID NO:2); FIG. 18C shows the nucleotide sequence of *Mus musculus* Complement Component 5 (C5) (SEQ ID NO:3); FIG. 18D shows the nucleotide sequence of *Rattus norvegicus* Complement Component 5 (C5) (SEQ ID NO:4); FIG. 18E shows the reverse complement of SEQ ID NO:1 (SEQ ID NO:5); FIG. 18F shows the reverse complement of SEQ ID NO:2 (SEQ ID NO:6); FIG. 18G shows the reverse complement of SEQ ID NO:3 (SEQ ID NO:7); and FIG. 18H shows the reverse complement of SEQ ID NO:4 (SEQ ID NO:8).

DETAILED DESCRIPTION OF THE INVENTION

Figure 1:
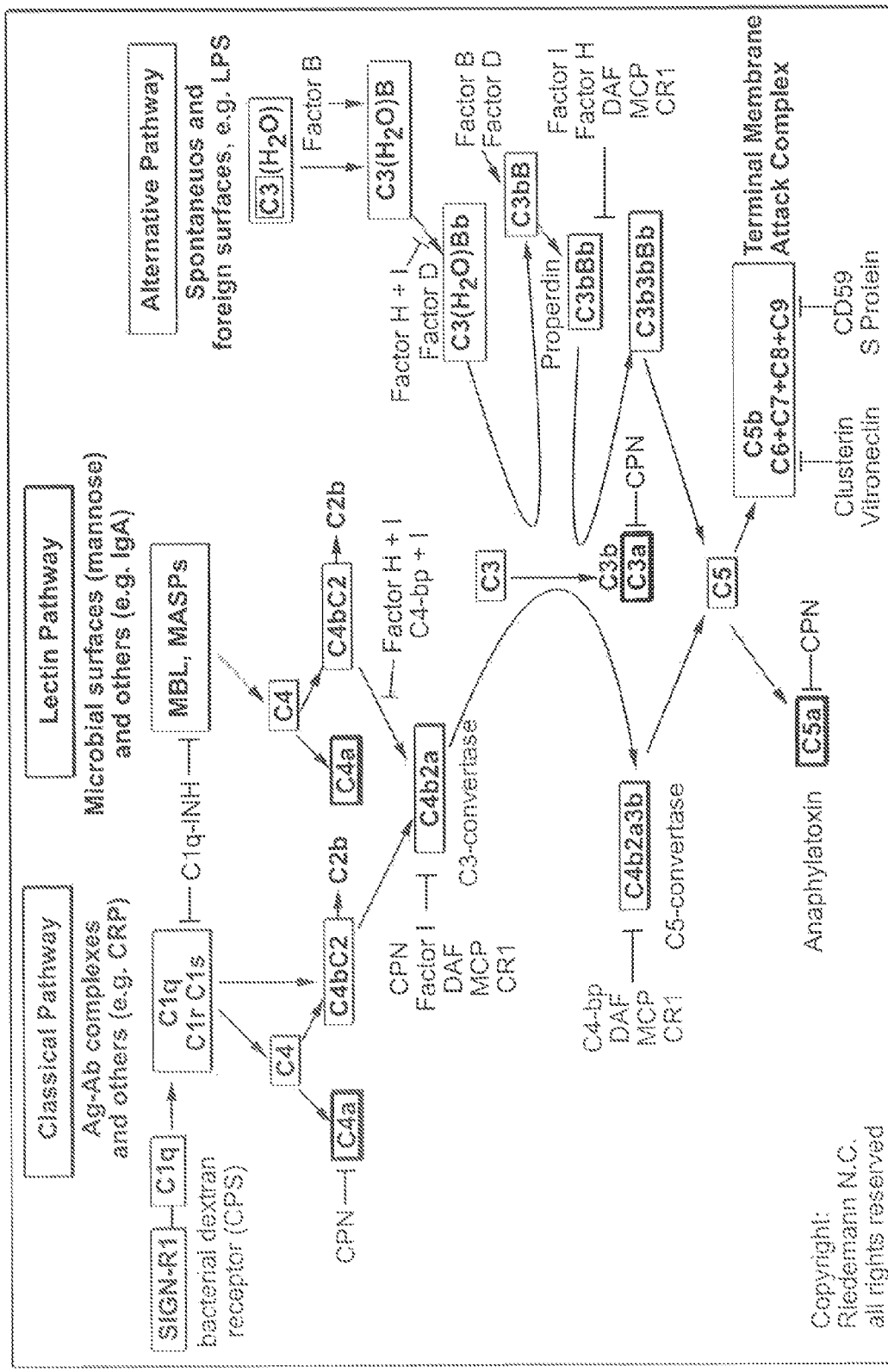
FIG. 1 is a schematic of the three complement pathways: alternative, classical and lectin.

The present invention provides iRNA agents which effect the RNA-induced silencing complex (RISC)-mediated cleavage of RNA transcripts of a complement component C5 gene.

The iRNAs of the invention include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a C5 gene. The use of these iRNAs enables the targeted degradation of mRNAs of a C5 gene in mammals. Very low dosages of C5 iRNAs, in particular, can specifically and efficiently mediate RNA interference (RNAi), resulting in significant inhibition of expression of a C5 gene. The present inventors have demonstrated that iRNAs targeting C5 can mediate RNAi in vitro and in vivo, resulting in significant inhibition of expression of a C5 gene. Thus, methods and compositions including these iRNAs are useful for treating a subject who would benefit by a reduction in the levels and/or activity of a C5 protein, such as a subject having a complement component C5-associated disease, such as paroxysmal nocturnal hemoglobinuria (PNH).

The present invention also provides methods and combination therapies for treating a subject having a disorder that would benefit from inhibiting or reducing the expression of a C5 gene, e.g., a complement component C5-associated disease, such as paroxysmal nocturnal hemoglobinuria (PNH) and atypical hemolytic uremic syndrome (aHUS) using iRNA compositions which effect the RNA-induced silencing complex (RISC)-mediated cleavage of RNA transcripts of a complement component C5 gene.

The present invention also provides methods for preventing at least one symptom, e.g., hemolysis, in a subject having a disorder that would benefit from inhibiting or reducing the expression of a C5 gene, e.g., a complement component C5-associated disease, such as paroxysmal nocturnal hemoglobinuria (PNH) and atypical hemolytic uremic syndrome (aHUS). The present invention further provides iRNA compositions which effect the RNA-induced silencing complex (RISC)-mediated cleavage of RNA transcripts of a complement component C5 gene. The C5 gene may be within a cell, e.g., a cell within a subject, such as a human.

The combination therapies of the present invention include administering to a subject having a complement component C5-associated disease, an RNAi agent of the invention and an additional therapeutic, such as anti-complement component C5 antibody, or antigen-binding fragment thereof, e.g., eculizumab. The combination therapies of the invention reduce C5 levels in the subject (e.g., by about 30%, 35%, 40%, 45%, 50%, 55%, 60%, 65%, 70%, 75%, 80%, 85%, 90%, 95%, or about 99%) by targeting C5 mRNA with an iRNA agent of the invention and, accordingly, allow the therapeutically (or prophylactically) effective amount of eculizumab required to treat the subject to be reduced, thereby decreasing the costs of treatment and permitting easier and more convenient ways of administering eculizumab, such as subcutaneous administration.

The following detailed description discloses how to make and use compositions containing iRNAs to inhibit the expression of a C5 gene, as well as compositions, uses, and methods for treating subjects having diseases and disorders that would benefit from inhibition and/or reduction of the expression of this gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise.

As used herein, "complement component C5," used interchangeably with the term "C5" refers to the well-known gene and polypeptide, also known in the art as CPAMD4, C3 and PZP-like alpha-2-macroglobulin domain-containing protein, anaphtlatoxin C5a analog, hemolytic complement (Hc), and complement C5. The sequence of a human C5 mRNA transcript can be found at, for example, GenBank Accession No. GI:38016946 (NM_001735.2; SEQ ID NO:1). The sequence of rhesus C5 mRNA can be found at, for example, GenBank Accession No. GI:297270262 (XM_001095750.2; SEQ ID NO:2). The sequence of mouse C5 mRNA can be found at, for example, GenBank Accession No. GI:291575171 (NM_010406.2; SEQ ID NO:3). The sequence of rat C5 mRNA can be found at, for example, GenBank Accession No. GI:392346248 (XM_345342.4; SEQ ID NO:4). Additional examples of C5 mRNA sequences are readily available using publicly available databases, e.g., GenBank.

The term "C5," as used herein, also refers to naturally occurring DNA sequence variations of the C5 gene, such as a single nucleotide polymorphism in the C5 gene. Numerous SNPs within the C5 gene have been identified and may be found at, for example, NCBI dbSNP (see, e.g., ncbi.nlm.nih.gov/snp). Non-limiting examples of SNPs within the C5 gene may be found at, NCBI dbSNP Accession Nos. rs121909588 and rs121909587.

As used herein, "target sequence" refers to a contiguous portion of the nucleotide sequence of an mRNA molecule formed during the transcription of a C5 gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of a C5 gene.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 2). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of C5 in a cell, e.g., a cell within a subject, such as a mammalian subject.

In one embodiment, an RNAi agent of the invention includes a single stranded RNA that interacts with a target RNA sequence, e.g., a C5 target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., a C5 gene. Accordingly, the term "siRNA" is also used herein to refer to an RNAi as described above.

In another embodiment, the RNAi agent may be a single-stranded siRNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150: 883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, an "iRNA" for use in the compositions, uses, and methods of the invention is a double-stranded RNA and is referred to herein as a "double stranded RNAi agent," "double-stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a C5 gene. In some embodiments of the invention, a double-stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. Such modifications may include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA of 24-30 nucleotides that interacts with a target RNA sequence, e.g., a C5 target mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409: 363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188).

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

"Blunt" or "blunt end" means that there are no unpaired nucleotides at that end of the double stranded RNAi agent, i.e., no nucleotide overhang. A "blunt ended" RNAi agent is a dsRNA that is double-stranded over its entire length, i.e., no nucleotide overhang at either end of the molecule. The RNAi agents of the invention include RNAi agents with nucleotide overhangs at one end (i.e., agents with one overhang and one blunt end) or with nucleotide overhangs at both ends.

The term "antisense strand" or "guide strand" refers to the strand of an iRNA, e.g., a dsRNA, which includes a region that is substantially complementary to a target sequence, e.g., a C5 mRNA. As used herein, the term "region of complementarity" refers to the region on the antisense strand that is substantially complementary to a sequence, for example a target sequence, e.g., a C5 nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, or 2 nucleotides of the 5'- and/or 3'-terminus of the iRNA.

The term "sense strand," or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding C5). For example, a polynucleotide is complementary to at least a part of a C5 mRNA if the sequence is substantially complementary to a non-interrupted portion of an mRNA encoding C5.

In general, the majority of nucleotides of each strand are ribonucleotides, but as described in detail herein, each or both strands can also include one or more non-ribonucleotides, e.g., a deoxyribonucleotide and/or a modified nucleotide. In addition, an "iRNA" may include ribonucleotides with chemical modifications. Such modifications may include all types of modifications disclosed herein or known in the art. Any such modifications, as used in an iRNA molecule, are encompassed by "iRNA" for the purposes of this specification and claims.

In one aspect of the invention, an agent for use in the methods and compositions of the invention is a single-stranded antisense RNA molecule that inhibits a target mRNA via an antisense inhibition mechanism. The single-stranded antisense RNA molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense RNA molecule may be about 15 to about 30 nucleotides in length and have a sequence that is complementary to a target sequence. For example, the single-stranded antisense RNA molecule may comprise a sequence that is at least about 15, 16, 17, 18, 19, 20, or more contiguous nucleotides from any one of the antisense sequences described herein.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815, 432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose). In an embodiment, the subject is a human, such as a human being treated or assessed for a disease, disorder or condition that would benefit from reduction in C5 expression; a human at risk for a disease, disorder or condition that would benefit from reduction in C5 expression; a human having a disease, disorder or condition that would benefit from reduction in C5 expression; and/or human being treated for a disease, disorder or condition that would benefit from reduction in C5 expression as described herein.

As used herein, the terms "treating" or "treatment" refer to a beneficial or desired result including, but not limited to, alleviation or amelioration of one or more symptoms associated with unwanted complement pathway activation (e.g., hemolysis and/or chronic inflammation); diminishing the extent of unwanted complement pathway activation; stabilization (i.e., not worsening) of the state of chronic inflammation and/or hemolysis; amelioration or palliation of unwanted complement pathway activation (e.g., chronic inflammation and/or hemolysis) whether detectable or undetectable. "Treatment" can also mean prolonging survival as compared to expected survival in the absence of treatment.

The term "lower" in the context of the level of a complement component C5 in a subject or a disease marker or symptom refers to a statistically significant decrease in such level. The decrease can be, for example, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more and is preferably down to a level accepted as within the range of normal for an individual without such disorder.

As used herein, "prevention" or "preventing," when used in reference to a disease, disorder or condition thereof, that would benefit from a reduction in expression of a C5 gene, refers to a reduction in the likelihood that a subject will develop a symptom associated with such a disease, disorder, or condition, e.g., a symptom of unwanted complement activation, such as a chronic inflammation, hemolysis and/or thrombosis. The likelihood of developing a thrombosis is reduced, for example, when an individual having one or more risk factors for a thrombosis either fails to develop a thrombosis or develops a thrombosis with less severity relative to a population having the same risk factors and not receiving treatment as described herein. The failure to develop a disease, disorder or condition, or the reduction in the development of a symptom associated with such a disease, disorder or condition (e.g., by at least about 10% on a clinically accepted scale for that disease or disorder), or the exhibition of delayed symptoms delayed (e.g., by days, weeks, months or years) is considered effective prevention.

As used herein, the term "complement component C5-associated disease" is a disease or disorder that is caused by, or associated with complement activation. Such diseases are typically associated with inflammation and/or immune system activation, e.g., membrane attack complex-mediated lysis, anaphylaxis, and/or hemolysis. Non-limiting examples of complement component C5-associated diseases include paroxysmal nocturnal hemoglobinuria (PNH), atypical hemolytic uremic syndrome (aHUS), asthma, rheumatoid arthritis (RA); antiphospholipid antibody syndrome; lupus nephritis; ischemia-reperfusion injury; typical or infectious hemolytic uremic syndrome (tHUS); dense deposit disease (DDD); neuromyelitis optica (NMO); multifocal motor neuropathy (MMN); multiple sclerosis (MS); macular degeneration (e.g., age-related macular degeneration (AMD)); hemolysis, elevated liver enzymes, and low platelets (HELLP) syndrome; thrombotic thrombocytopenic purpura (TTP); spontaneous fetal loss; Pauci-immune vasculitis; epidermolysis bullosa; recurrent fetal loss; pre-eclampsia, traumatic brain injury, myasthenia gravis, cold agglutinin disease, dermatomyositis bullous pemphigoid, Shiga toxin *E. coli*-related hemolytic uremic syndrome, C3 nephropathy, anti-neutrophil cytoplasmic antibody-associated vasculitis (e.g., granulomatosis with polyangiitis (previously known as Wegener granulomatosis), Churg-Strauss syndrome, and microscopic polyangiitis), humoral and vascular transplant rejection, graft dysfunction, myocardial infarction (e.g., tissue damage and ischemia in myocardial infarction), an allogenic transplant, sepsis (e.g., poor outcome in sepsis), Coronary artery disease, dermatomyositis, Graves' disease, atherosclerosis, Alzheimer's disease, systemic inflammatory response sepsis, septic shock, spinal cord injury, glomerulonephritis, Hashimoto's thyroiditis, type I diabetes, psoriasis, pemphigus, autoimmune hemolytic anemia (AIHA), ITP, Goodpasture syndrome, Degos disease, antiphospholipid syndrome (APS), catastrophic APS (CAPS), a cardiovascular disorder, myocarditis, a cerebrovascular disorder, a peripheral (e.g., musculoskeletal) vascular disorder, a renovascular disorder, a mesenteric/enteric vascular disorder, vasculitis, Henoch-Schönlein purpura nephritis, systemic lupus erythematosus-associated vasculitis, vasculitis associated with rheumatoid arthritis, immune complex vasculitis, Takayasu's disease, dilated cardiomyopathy, diabetic angiopathy, Kawasaki's disease (arteritis), venous gas embolus (VGE), and restenosis following stent placement, rotational atherectomy, membraneous nephropathy, Guillain-Barre syndrome, and percutaneous transluminal coronary angioplasty (PTCA) (see, e.g., Holers (2008) Immunological Reviews 223:300-316; Holers and Thurman (2004) Molecular Immunology 41:147-152; U.S. Patent Publication No. 20070172483).

In one embodiment, a complement component C5-associated disease is paroxysmal nocturnal hemoglobinuria (PNH). The PNH may be classical PNH or PNH in the setting of another bone marrow failure syndrome and/or myelodysplastic syndromes (MDS), e.g., cytopenias. In another embodiment, a complement component C5-associated disease is atypical hemolytic uremic syndrome (aHUS).

II. iRNAS of the Invention

The present invention provides iRNAs which inhibit the expression of a complement component C5 gene. In one embodiment, the iRNA agent includes double-stranded ribonucleic acid (dsRNA) molecules for inhibiting the expression of a C5 gene in a cell, such as a cell within a subject, e.g., a mammal, such as a human having a complement component C5-associated disease, e.g., PNH. The dsRNA includes an antisense strand having a region of complementarity which is complementary to at least a part of an mRNA formed in the expression of a C5 gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the C5 gene, the iRNA inhibits the expression of the C5 gene (e.g., a human, a primate, a non-primate, or a bird C5 gene) by at least about 10% as assayed by, for example, a PCR or branched DNA (bDNA)-based method, or by a protein-based method, such as by immunofluorescence analysis, using, for example, Western Blotting or flowcytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a C5 gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is between about 15 and about 20 nucleotides in length, or between about 25 and about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target C5 expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double-stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In one aspect, a dsRNA of the invention includes at least two nucleotide sequences, a sense sequence and an anti-sense sequence. The sense strand is selected from the group of sequences provided in any one of Tables 3, 4, 5, 6, 18, 19, 20, 21, and 23, and the corresponding antisense strand of the sense strand is selected from the group of sequences of any one of Tables 3, 4, 5, 6, 18, 19, 20, 21, and 23. In this aspect, one of the two sequences is complementary to the other of the two sequences, with one of the sequences being substantially complementary to a sequence of an mRNA generated in the expression of a C5 gene. As such, in this aspect, a dsRNA will include two oligonucleotides, where one oligonucleotide is described as the sense strand in any one of Tables 3, 4, 5, 6, 18, 19, 20, 21, and 23, and the second oligonucleotide is described as the corresponding antisense strand of the sense strand in any one of Tables 3, 4, 5, 6, 18, 19, 20, 21, and 23. In one embodiment, the substantially complementary sequences of the dsRNA are contained on separate oligonucleotides. In another embodiment, the substantially complementary sequences of the dsRNA are contained on a single oligonucleotide.

It will be understood that, although some of the sequences in Tables 3, 4, 5, 6, 18, 19, 20, 21, and 23 are described as modified and/or conjugated sequences, the RNA of the iRNA of the invention e.g., a dsRNA of the invention, may comprise any one of the sequences set forth in Tables 3, 4, 5, 6, 18, 19, 20, 21, and 23 that is un-modified, un-conjugated, and/or modified and/or conjugated differently than described therein.

The skilled person is well aware that dsRNAs having a duplex structure of between about 20 and 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) RNA 14:1714-1719; Kim et al. (2005) *Nat Biotech* 23:222-226). In the embodiments described above, by virtue of the nature of the oligonucleotide sequences provided in any one of Tables 3, 4, 5, 6, 18, 19, 20, 21, and 23, dsRNAs described herein can include at least one strand of a length of minimally 21 nucleotides. It can be reasonably expected that shorter duplexes having one of the sequences of any one of Tables 3, 4, 5, 6, 18, 19, 20, 21, and 23 minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences of any one of Tables 3, 4, 5, 6, 18, 19, 20, 21, and 23, and differing in their ability to inhibit the expression of a C5 gene by not more than about 5, 10, 15, 20, 25, or 30% inhibition from a dsRNA comprising the full sequence, are contemplated to be within the scope of the present invention.

In addition, the RNAs provided in any one of Tables 3, 4, 5, 6, 18, 19, 20, 21, and 23 identify a site(s) in a C5 transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided in any one of Tables 3, 4, 5, 6, 18, 19, 20, 21, and 23 coupled to additional nucleotide sequences taken from the region contiguous to the selected sequence in a C5 gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified, for example, in any one of Tables 3, 4, 5, 6, 18, 19, 20, 21, and 23 represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in any one of Tables 3, 4, 5, 6, 18, 19, 20, 21, and 23, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of a C5 gene, generally does not contain any mismatch within the central 13 nucleotides. The methods described herein or methods known in the art can be used to determine whether an iRNA containing a mismatch to a target sequence is effective in inhibiting the expression of a C5 gene. Consideration of the efficacy of iRNAs with mismatches in inhibiting expression of a C5 gene is important, especially if the particular region of complementarity in a C5 gene is known to have polymorphic sequence variation within the population.

III. Modified iRNAS of the Invention

In one embodiment, the RNA of the iRNA of the invention e.g., a dsRNA, is un-modified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified. iRNAs of the invention in which "substantially all of the nucleotides are modified" are largely but not wholly modified and can include not more than 5, 4, 3, 2, or 1 unmodified nucleotides.

The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476, 301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. No. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular —CH$_2$—NH—CH$_2$—, —CH$_2$—N(CH$_3$)—O—CH$_2$-[known as a methylene (methylimino) or MMI backbone], —CH$_2$—O—N(CH$_3$)—CH$_2$—, —CH$_2$—N(CH$_3$)—N(CH$_3$)—CH$_2$— and —N(CH$_3$)—CH$_2$—CH$_2$-[wherein the native phosphodiester backbone is represented as —O—P—O—CH$_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted C$_1$ to C$_{10}$ alkyl or C$_2$ to C$_{10}$ alkenyl and alkynyl. Exemplary suitable modifications include O[(CH$_2$)$_n$O]$_m$CH$_3$, O(CH$_2$).$_n$OCH$_3$, O(CH$_2$)$_n$NH$_2$, O(CH$_2$)$_n$CH$_3$, O(CH$_2$)$_n$ONH$_2$, and O(CH$_2$)$_n$ON[(CH$_2$)$_n$CH$_3$)]$_2$, where n and m are from 1 to about 10. In other embodiments, dsRNAs include one of the following at the 2' position: C$_1$ to C$_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—CH$_2$CH$_2$OCH$_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a O(CH$_2$)$_2$ON(CH$_3$)$_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_3$)$_2$.

Other modifications include 2'-methoxy (2'-OCH$_3$), 2'-aminopropoxy (2'-OCH$_2$CH$_2$CH$_2$NH$_2$) and 2'-fluoro (2'-F). Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193).

Representative U.S. patents that teach the preparation of locked nucleic acid nucleotides include, but are not limited to, the following: U.S. Pat. Nos. 6,268,490; 6,670,461; 6,794, 499; 6,998,484; 7,053,207; 7,084,125; and 7,399,845, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-0-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

A. Modified iRNAs Comprising Motifs of the Invention

In certain aspects of the invention, the double-stranded RNAi agents of the invention include agents with chemical modifications as disclosed, for example, in U.S. Provisional Application No. 61/561,710, filed on Nov. 18, 2011, or in PCT/US2012/065691, filed on Nov. 16, 2012, the entire contents of each of which are incorporated herein by reference.

As shown herein and in Provisional Application No. 61/561,710 or PCT Application No. PCT/US2012/065691, a superior result may be obtained by introducing one or more motifs of three identical modifications on three consecutive nucleotides into a sense strand and/or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense and/or antisense strand. The RNAi agent may be optionally conjugated with a GalNAc derivative ligand, for instance on the sense strand. The resulting RNAi agents present superior gene silencing activity.

More specifically, it has been surprisingly discovered that when the sense strand and antisense strand of the double-stranded RNAi agent are completely modified to have one or more motifs of three identical modifications on three consecutive nucleotides at or near the cleavage site of at least one strand of an RNAi agent, the gene silencing activity of the RNAi agent was superiorly enhanced.

Accordingly, the invention provides double-stranded RNAi agents capable of inhibiting the expression of a target gene (i.e., a complement component C5 (C5) gene) in vivo. The RNAi agent comprises a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-Omethyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand. When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (preferably GalNAc$_3$).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal. Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the 1$^{st}$ nucleotide from the 5'-end of the antisense strand, or, the count starting from the 1$^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAAB-BAABB . . . ," "AABAABAABAAB . . . ," "AAABAAA-BAAAB . . . ," "AAABBBAAABBB . . . ," or "ABCABCAB-CABC . . . ," etc.

The type of modifications contained in the alternating motif may be the same or different.

For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3' of the strand within the duplex region. As another example, the alternating motif in the sense strand may start with "AABBAABB" from 5'-3' of the strand and the alternating motif in the antisense strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing activity to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYYN$_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both strands in any position of the strand. For instance, the internucleotide linkage modification may occur on every nucleotide on the sense strand and/or antisense strand; each internucleotide linkage modification may occur in an alternating pattern on the sense strand and/or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In one embodiment, the antisense strand comprises two phosphorothioate internucleotide linkages at the 5'-terminus and two phosphorothioate internucleotide linkages at the 3'-terminus, and the sense strand comprises at least two phosphorothioate internucleotide linkages at either the 5'-terminus or the 3'-terminus.

In one embodiment, the RNAi comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, and/or the 5'end of the antisense strand.

In one embodiment, the 2 nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the RNAi agent may additionally have two phosphorothioate internucleotide linkages between the terminal three nucleotides at both the 5'-end of the sense strand and at the 5'-end of the antisense strand.

In one embodiment, the RNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense and/or antisense strand.

In one embodiment, the sense strand sequence may be represented by formula (I):

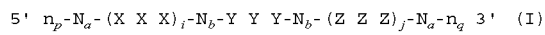

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides; each $N_b$ independently represents an oligonucleotide sequence comprising 0-10 modified nucleotides;
each $n_p$ and $n_q$ independently represent an overhang nucleotide;
wherein Nb and Y do not have the same modification; and XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the 1st nucleotide, from the 5'-end; or optionally, the count starting at the 1st paired nucleotide within the duplex region, from the 5'-end.

In one embodiment, i is 1 and j is 0, or i is 0 and j is 1, or both i and j are 1. The sense strand can therefore be represented by the following formulas:

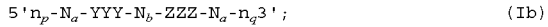
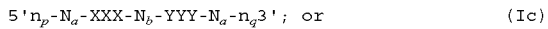
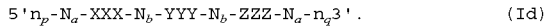

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

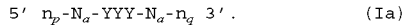

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

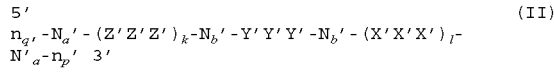

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b'$ and Y' do not have the same modification; and
X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the 1st nucleotide, from the 5'-end; or optionally, the count starting at the 1st paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

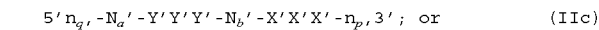
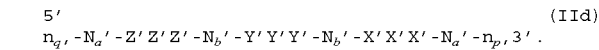

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

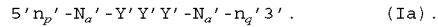

When the antisense strand is represented as formula (IIa), each $N_a'$ independently represents an oligonucleotide sequence comprising 2-20, 2-15, or 2-10 modified nucleotides.

Each of X, Y' and Z' may be the same or different from each other.

Each nucleotide of the sense strand and antisense strand may be independently modified with LNA, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the 1st nucleotide from the 5'-end, or optionally, the count starting at the 1st paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the 1$^{st}$ nucleotide from the 5'-end, or optionally, the count starting at the 1$^{st}$ paired nucleotide within the duplex region, from the 5'-end; and Y'represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

```
sense:     5'n_p-N_a-(XXX)_i-N_b-YYY-N_b-(ZZZ)_j-N_a-n_q3'           (III)
antisense:3'n_p'-N_a-(X'X'X')_k-N_b-Y'Y'Y'-N_b-(Z'Z'Z')_l-N_a-n_q5'
``` wherein:
i, j, k, and l are each independently 0 or 1;
p, p', q, and q' are each independently 0-6;
each $N_a$ and $N_a$ independently represents an oligonucleotide sequence comprising 0-25 modified nucleotides, each sequence comprising at least two differently modified nucleotides;
each $N_b$ and $N_b$ independently represents an oligonucleotide sequence comprising 0-10 modified nucleotides;
wherein
each $n_p$, $n_p'$, $n_q$, and $n_q'$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

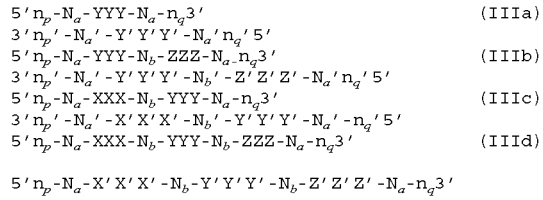

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b'$ independently represents an oligonucleotide sequence comprising 0-10, 0-7, 0-10, 0-7, 0-5, 0-4, 0-2 or 0modified nucleotides. Each $N_a$ independently represents an oligonucleotide sequence comprising 2-20, 2-15, or 2-10 modified nucleotides.

When the RNAi agent is represented as formula (IIId), each $N_b$, $N_b'$ independently represents an oligonucleotide sequence comprising 0-10, 0-7, 0-10, 0-7, 0-5, 0-4, 0-2 or 0modified nucleotides. Each $N_a$, $N_a'$ independently represents an oligonucleotide sequence comprising 2-20, 2-15, or 2-10 modified nucleotides. Each of $N_a$, $N_a'$, $N_b$ and $N_b$ independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the invention. Such publications include WO2007/091269, U.S. Pat. No. 7,858,769, WO2010/141511, WO2007/117686, WO2009/014887 and WO2011/031520 the entire contents of each of which are hereby incorporated herein by reference.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the invention is an agent selected from the group of agents listed in any one of Tables 3, 4, 5, 6, 18, 19, 20, 21, and 23. These agents may further comprise a ligand.

IV. iRNAS Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., *Proc. Natl. Acid. Sci. USA*, 1989, 86: 6553-6556), cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylamino-carbonyloxycholesterol moiety (Crooke et al., *J. Pharmacol. Exp. Ther.*, 1996, 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucoseamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, bomeol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide.

In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells.

Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 9). An RFGF analogue (e.g., amino acid sequence AALLPVLLAAP (SEQ ID NO: 10) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 11) and the *Drosophila* Antennapedia protein (RQIKIWFQNRRMKWKK (SEQ ID NO: 12) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, a α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the invention is a monosaccharide. In one embodiment, the monosaccharide is an N-acetylgalactosamine, such as

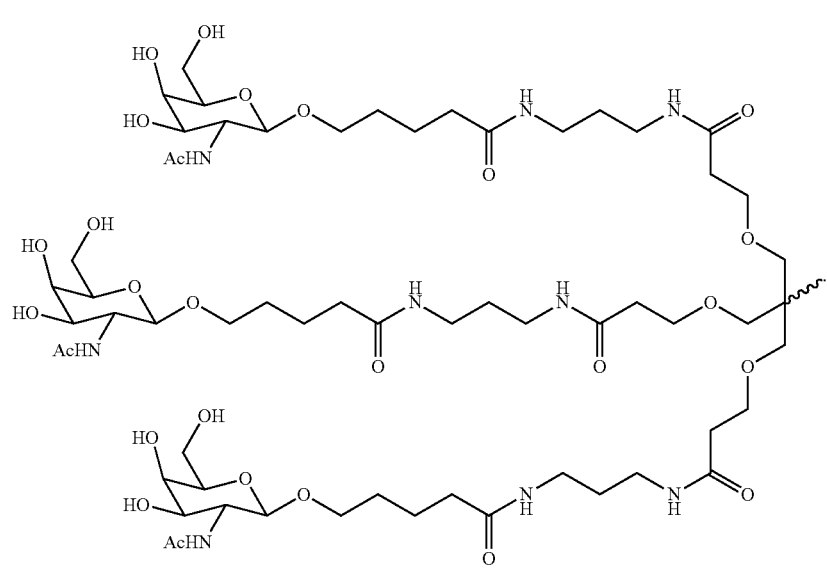 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

Formula II

In another embodiment, a carbohydrate conjugate for use in the compositions and methods of the invention is selected from the group consisting of:

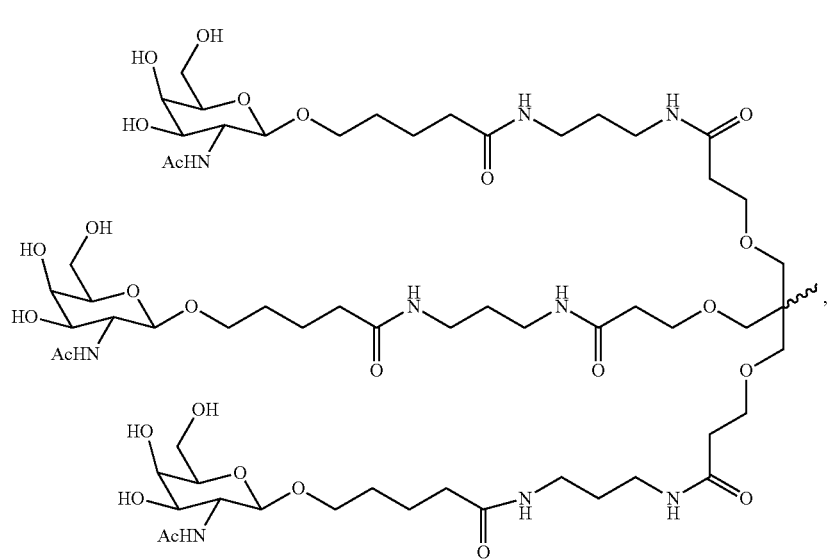

Formula II

-continued
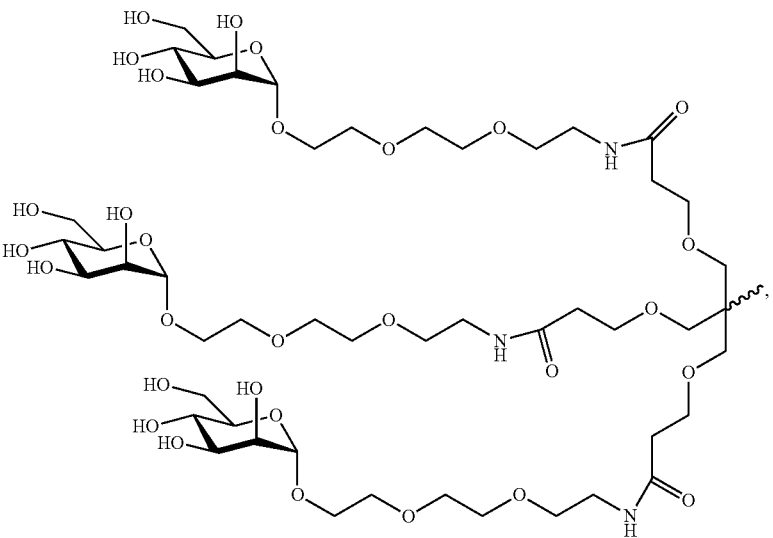
Formula III
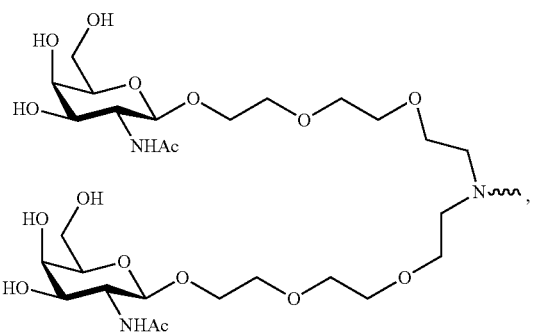
Formula IV
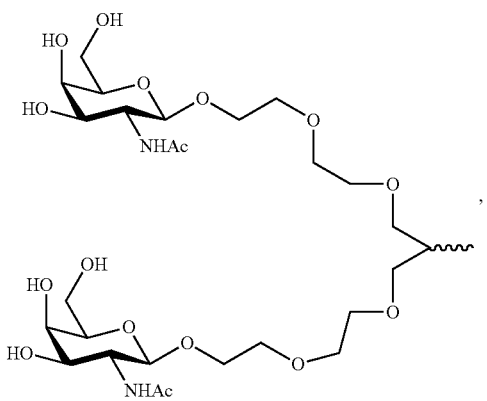
Formula V
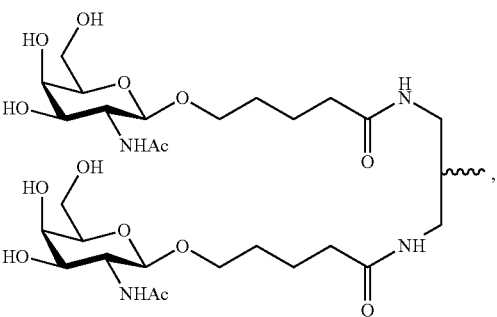
Formula VI
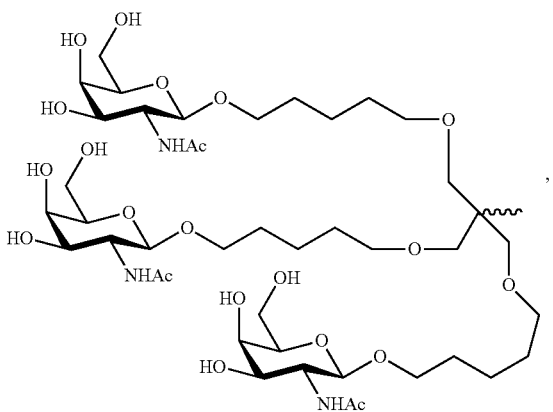
Formula VII
Formula VIII
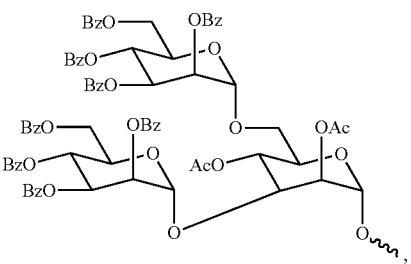

-continued
Formula IX
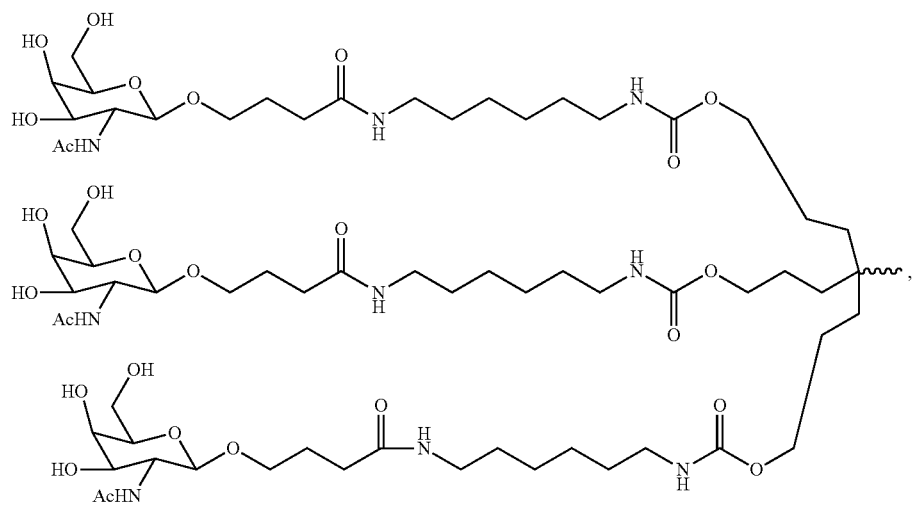
Formula X
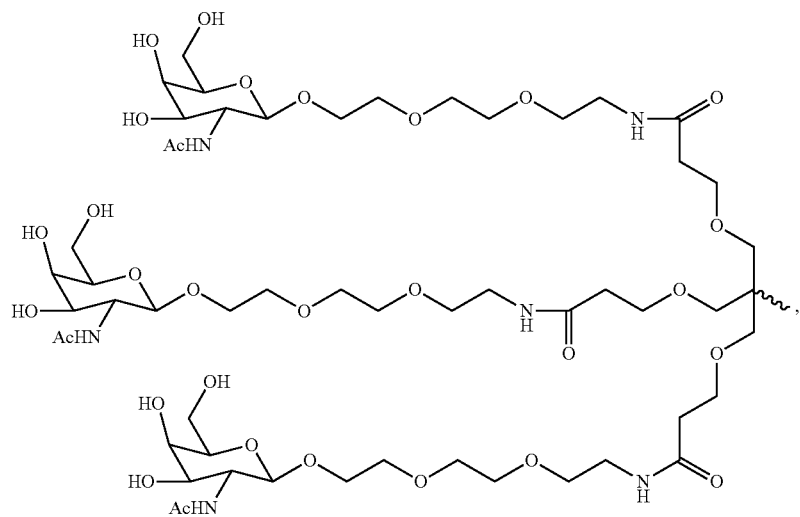
Formula XI
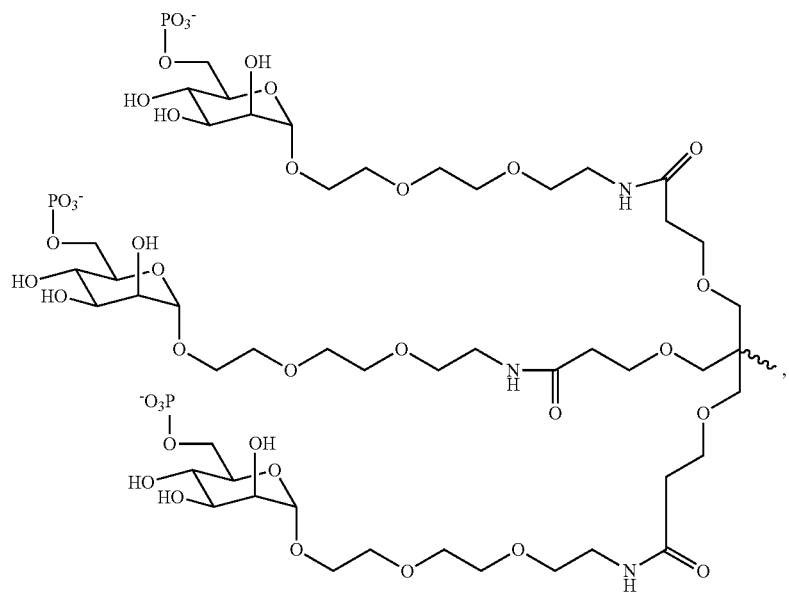

Formula XII
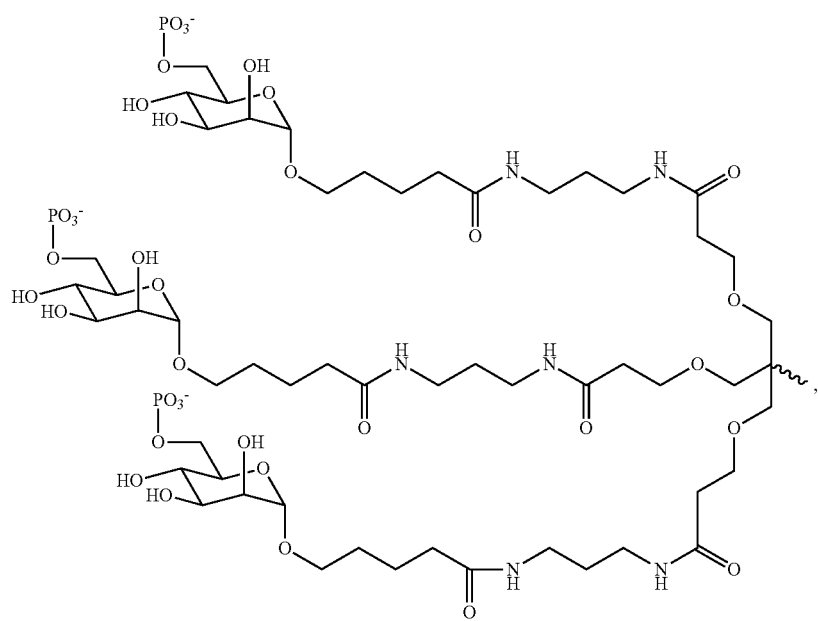
Formula XIII
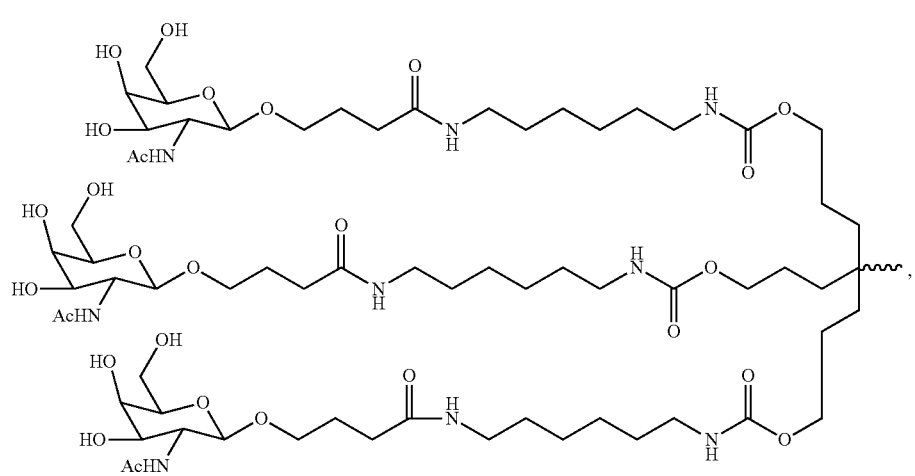
Formula XIV
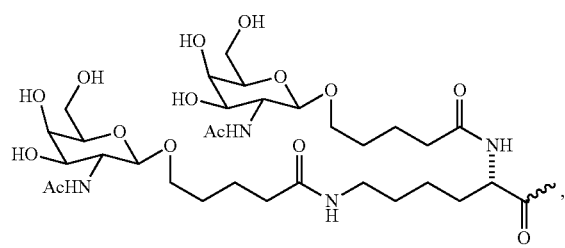
Formula XV
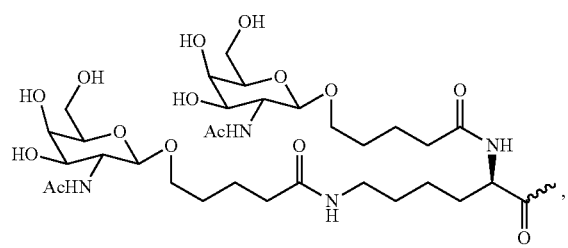
Formula XVI
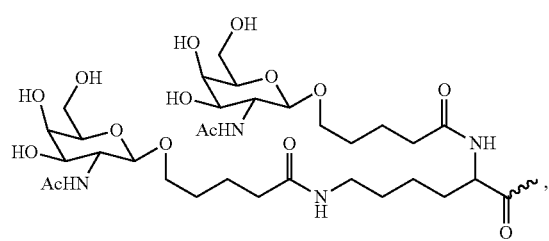
Formula XVII
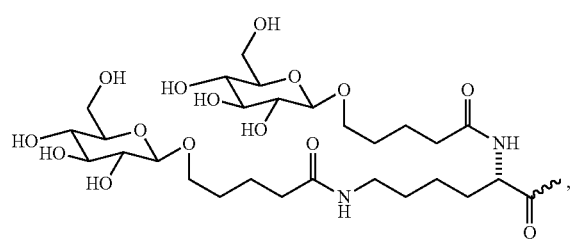

Formula XVIII
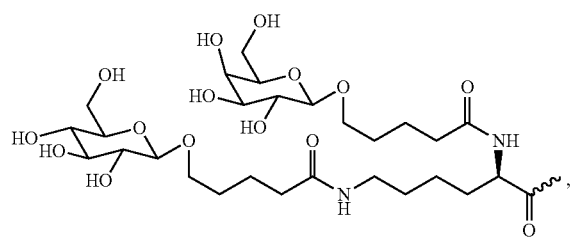
Formula XIX
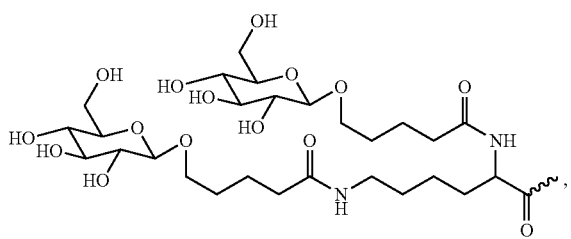
Formula XX
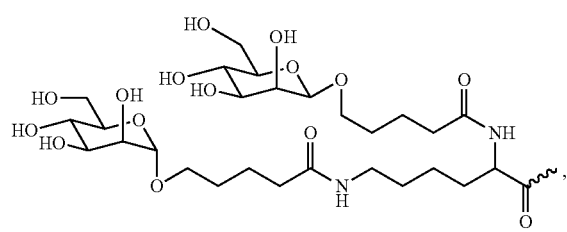
Formula XXI
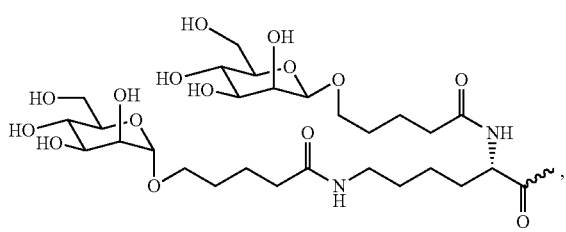
Formula XXII
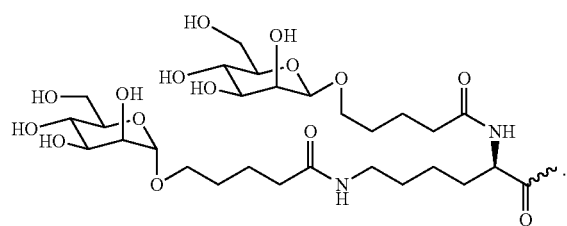
Another representative carbohydrate conjugate for use in the embodiments described herein includes, but is not limited to
(Formula XXIII)
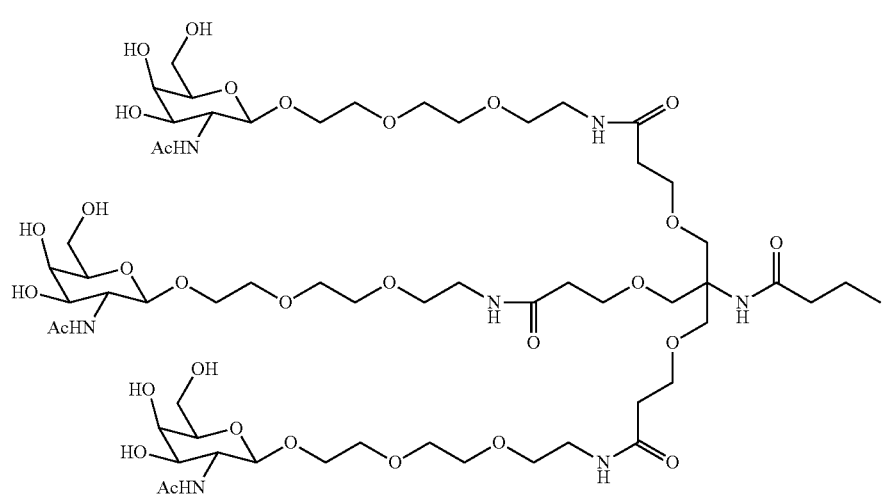

-continued

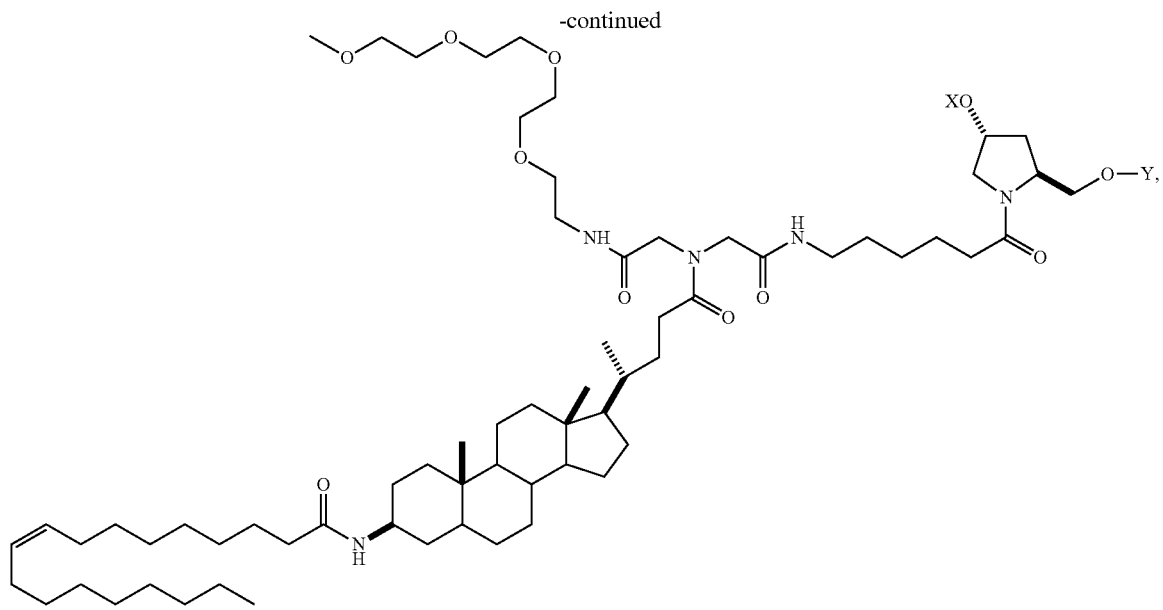

when one of X or Y is an oligonucleotide, the other is a hydrogen.

In some embodiments, the carbohydrate conjugate further comprises one or more additional ligands as described above, such as, but not limited to, a PK modulator and/or a cell permeation peptide.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylherocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S) (OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to, (Formula XXIV)
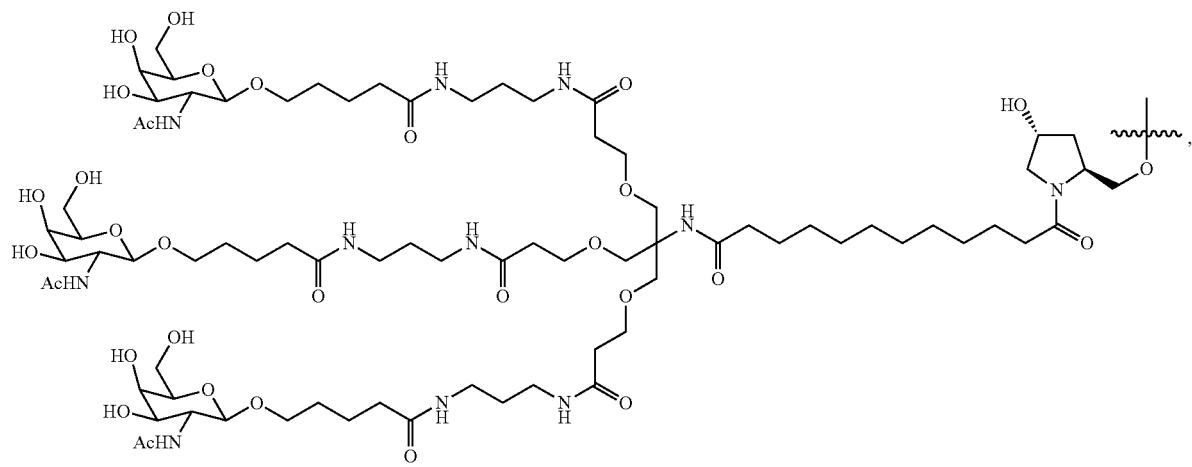
(Formula XXV)
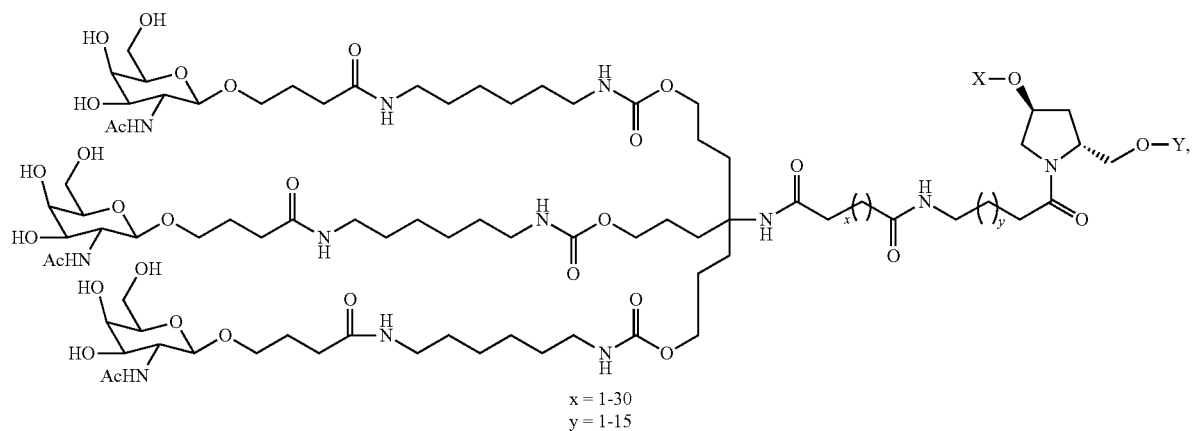
x = 1-30
y = 1-15
(Formula XXVI)
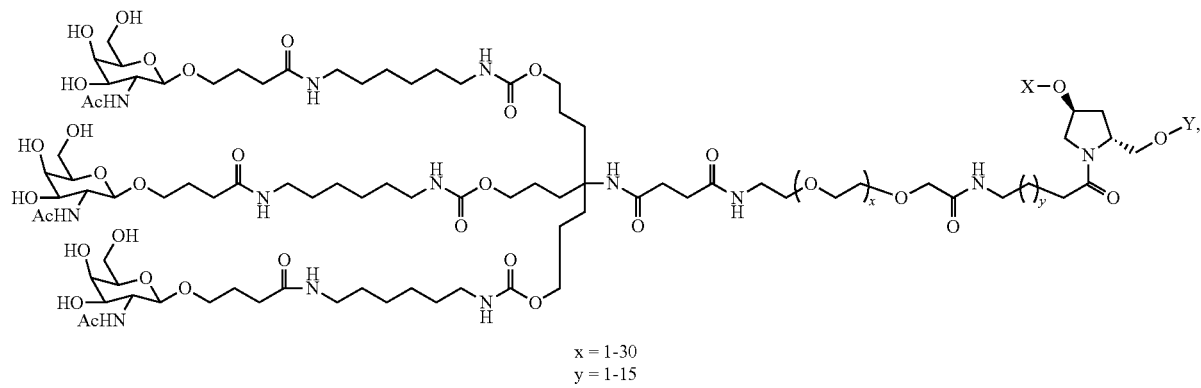
x = 1-30
y = 1-15

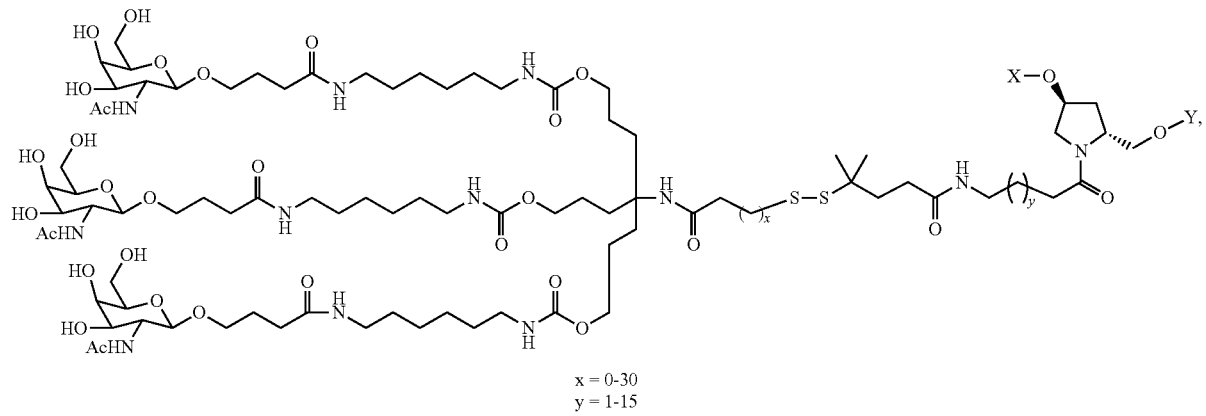
(Formula XXVII)
x = 0-30
y = 1-15
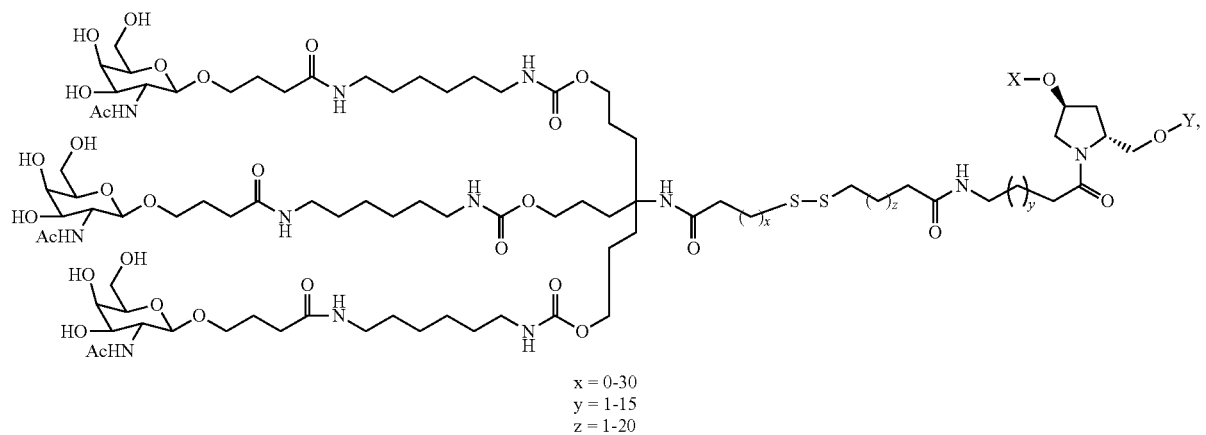
(Formula XXVIII)
x = 0-30
y = 1-15
z = 1-20
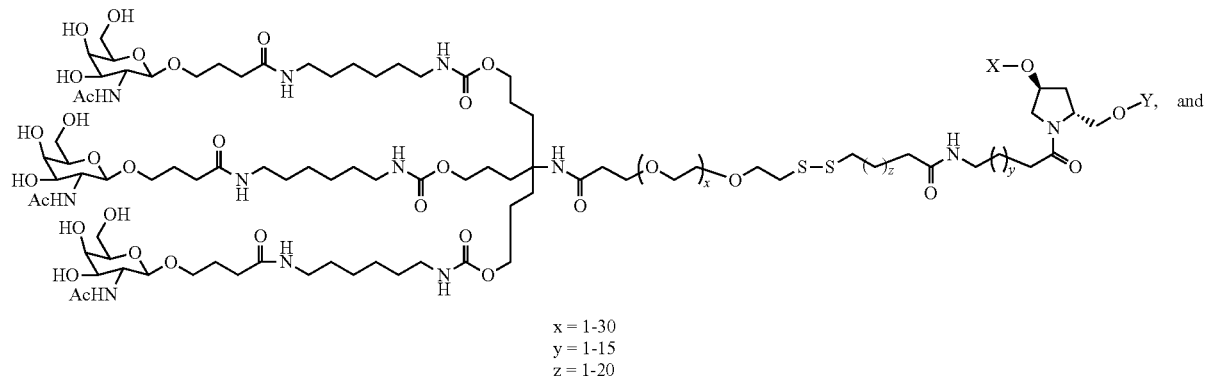
(Formula XXIX)
x = 1-30
y = 1-15
z = 1-20
and (Formula XXX)

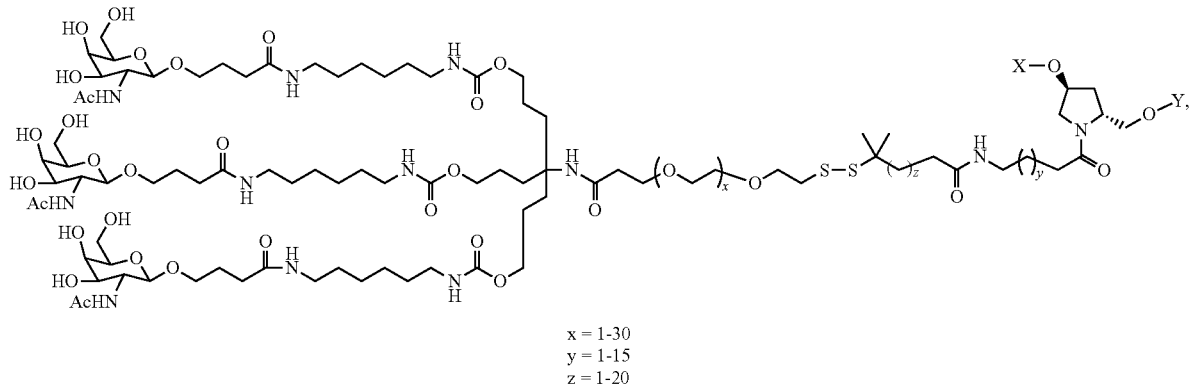

x = 1-30
y = 1-15
z = 1-20 when one of X or Y is an oligonucleotide, the other is a hydrogen.

In certain embodiments of the compositions and methods of the invention, a ligand is one or more "GalNAc" (N-acetyl-galactosamine) derivatives attached through a bivalent or trivalent branched linker.

In one embodiment, a dsRNA of the invention is conjugated to a bivalent or trivalent branched linker selected from the group of structures shown in any of formula (XXXI)-(XXXIV):

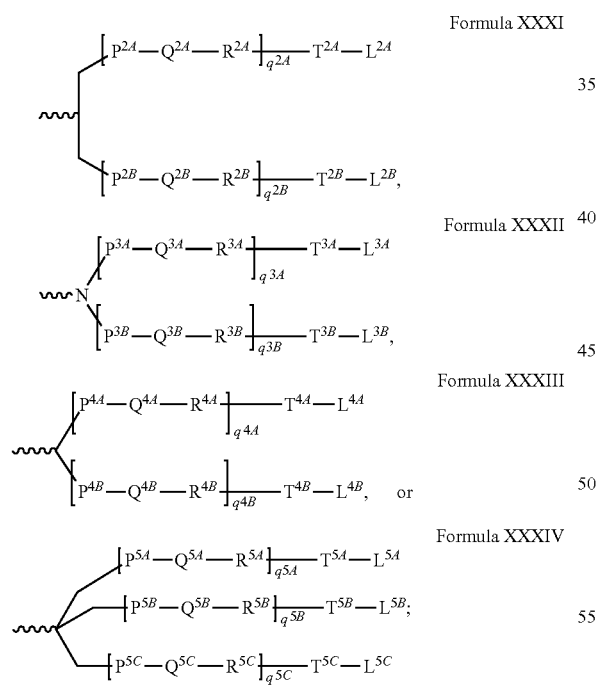

wherein:
q2A, q2B, q3A, q3B, q4A, q4B, q5A, q5B and q5C represent independently for each occurrence 0-20 and wherein the repeating unit can be the same or different;
$p^{2A}, p^{2B}, p^{3A}, p^{3B}, p^{4A}, p^{4B}, p^{5A}, p^{5B}, p^{5C}, T^{2A}, T^{2B}, T^{3A}, T^{3B}, T^{4A}, T^{4B}, T^{4A}, T^{5B}, T^{5C}$ are each independently for each occurrence absent, CO, NH, O, S, OC(O), NHC(O), $CH_2$, $CH_2NH$ or $CH_2O$;

$Q^{2A}, Q^{2B}, Q^{3A}, Q^{3B}, Q^{4A}, Q^{4B}, Q^{5A}, Q^{5B}, Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R''), C≡C or C(O);

$R^{2A}, R^{2B}, R^{3A}, R^{3B}, R^{4A}, R^{4B}, R^{5A}, R^{5B}, R^{5C}$ are each independently for each occurrence absent, NH, O, S, $CH_2$, C(O)O, C(O)NH, $NHCH(R^a)C(O)$, —C(O)—$CH(R^a)$—NH—, CO, CH=N—O, ![structures]

heterocyclyl;

$L^{2A}, L^{2B}, L^{3A}, L^{3B}, L^{4A}, L^{4B}, L^{5A}, L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

Formula XXXV

![formula XXXV structure]

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyl-oxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject having a complement component C5-associated disease) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol*. 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) *Retina* 24:132-138) and subretinal injections in mice (Reich, S J., et al (2003) *Mol. Vis.* 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66;

Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol*. 93:594-602) and to the lungs by intranasal administration (Howard, K A., et al (2006) *Mol. Ther.* 14:476-484; Zhang, X., et al (2004) *J. Biol. Chem.* 279:10677-10684; Bitko, V., et al (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O., et al (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) *J. Mol. Biol* 327:761-766; Verma, U N., et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) *Nature* 441:111-114), cardiolipin (Chien, P Y., et al (2005) *Cancer Gene Ther.* 12:321-328; Pal, A., et al (2005) *Int J. Oncol.* 26:1087-1091), polyethyleneimine (Bonnet M E., et al (2008) *Pharm. Res*. August 16 Epub ahead of print; Aigner, A. (2006) *J. Biomed. Biotechnol.* 71659), Arg-Gly-Asp (RGD) peptides (Liu, S. (2006) *Mol. Pharm*. 3:472-487), and polyamidoamines (Tomalia, D A., et al (2007) *Biochem. Soc. Trans*. 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector encoded iRNAs of the Invention iRNA targeting the C5 gene can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g., Transit-TKO™). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, *FASEB J.* 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

Viral vectors that contain nucleic acid sequences encoding an iRNA can be used. For example, a retroviral vector can be used (see Miller et al., *Meth. Enzymol.* 217:581-599 (1993)). These retroviral vectors contain the components necessary for the correct packaging of the viral genome and integration into the host cell DNA. The nucleic acid sequences encoding an iRNA are cloned into one or more vectors, which facilitate delivery of the nucleic acid into a patient. More detail about retroviral vectors can be found, for example, in Boesen et al., *Biotherapy* 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., *J. Clin. Invest.* 93:644-651 (1994); Kiem et al., *Blood* 83:1467-1473 (1994); Salmons and Gunzberg, *Human Gene Therapy* 4:129-141 (1993); and Grossman and Wilson, *Curr. Opin. in Genetics and Devel.* 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs of the invention. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, *Current Opinion in Genetics and Development* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J. Clin. Invest.* 91:225-234 (1993); PCT Publication WO94/12649; and Wang, et al., *Gene Therapy* 2:775-783 (1995). A suitable AV vector for expressing an iRNA featured in the invention, a method for constructing the recombinant AV vector, and a method for delivering the vector into target cells, are described in Xia H et al. (2002), *Nat. Biotech.* 20: 1006-1010.

Adeno-associated virus (AAV) vectors may also be used to delivery an iRNA of the invention (Walsh et al., Proc. Soc. Exp. Biol. Med. 204:289-300 (1993); U.S. Pat. No. 5,436, 146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), *J. Virol.* 61: 3096-3101; Fisher K J et al. (1996), *J. Virol,* 70: 520-532; Samulski R et al. (1989), *J. Virol.* 63: 3822-3826; U.S. Pat. No. 5,252,479; U.S. Pat. No. 5,139,941; International Patent Application No. WO 94/13788; and International Patent Application No. WO 93/24641, the entire disclosures of which are herein incorporated by reference.

Another viral vector suitable for delivery of an iRNA of the invevtion is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), *J Virol* 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier.

The phrase "pharmaceutically acceptable" is employed herein to refer to those compounds, materials, compositions, and/or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt;

(6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; and (22) other non-toxic compatible substances employed in pharmaceutical formulations.

The pharmaceutical compositions containing the iRNA are useful for treating a disease or disorder associated with the expression or activity of a C5 gene, e.g. a complement component C5-associated disease. Such pharmaceutical compositions are formulated based on the mode of delivery. One example is compositions that are formulated for systemic administration via parenteral delivery, e.g., by subcutaneous (SC) or intravenous (IV) delivery. Another example is compositions that are formulated for direct delivery into the brain parenchyma, e.g., by infusion into the brain, such as by continuous pump infusion. The pharmaceutical compositions of the invention may be administered in dosages sufficient to inhibit expression of a C5 gene. In general, a suitable dose of an iRNA of the invention will be in the range of about 0.001 to about 200.0 milligrams per kilogram body weight of the recipient per day, generally in the range of about 1 to 50 mg per kilogram body weight per day. For example, the dsRNA can be administered at about 0.01 mg/kg, about 0.05 mg/kg, about 0.5 mg/kg, about 1 mg/kg, about 1.5 mg/kg, about 2 mg/kg, about 3 mg/kg, about 10 mg/kg, about 20 mg/kg, about 30 mg/kg, about 40 mg/kg, or about 50 mg/kg per single dose.

For example, the dsRNA may be administered at a dose of about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, or about 10 mg/kg. Values and ranges intermediate to the recited values are also intended to be part of this invention.

In another embodiment, the dsRNA is administered at a dose of about 0.1 to about 50 mg/kg, about 0.25 to about 50 mg/kg, about 0.5 to about 50 mg/kg, about 0.75 to about 50 mg/kg, about 1 to about 50 mg/mg, about 1.5 to about 50 mg/kb, about 2 to about 50 mg/kg, about 2.5 to about 50 mg/kg, about 3 to about 50 mg/kg, about 3.5 to about 50 mg/kg, about 4 to about 50 mg/kg, about 4.5 to about 50 mg/kg, about 5 to about 50 mg/kg, about 7.5 to about 50 mg/kg, about 10 to about 50 mg/kg, about 15 to about 50 mg/kg, about 20 to about 50 mg/kg, about 20 to about 50 mg/kg, about 25 to about 50 mg/kg, about 25 to about 50 mg/kg, about 30 to about 50 mg/kg, about 35 to about 50 mg/kg, about 40 to about 50 mg/kg, about 45 to about 50 mg/kg, about 0.1 to about 45 mg/kg, about 0.25 to about 45 mg/kg, about 0.5 to about 45 mg/kg, about 0.75 to about 45 mg/kg, about 1 to about 45 mg/mg, about 1.5 to about 45 mg/kb, about 2 to about 45 mg/kg, about 2.5 to about 45 mg/kg, about 3 to about 45 mg/kg, about 3.5 to about 45 mg/kg, about 4 to about 45 mg/kg, about 4.5 to about 45 mg/kg, about 5 to about 45 mg/kg, about 7.5 to about 45 mg/kg, about 10 to about 45 mg/kg, about 15 to about 45 mg/kg, about 20 to about 45 mg/kg, about 20 to about 45 mg/kg, about 25 to about 45 mg/kg, about 25 to about 45 mg/kg, about 30 to about 45 mg/kg, about 35 to about 45 mg/kg, about 40 to about 45 mg/kg, about 0.1 to about 40 mg/kg, about 0.25 to about 40 mg/kg, about 0.5 to about 40 mg/kg, about 0.75 to about 40 mg/kg, about 1 to about 40 mg/mg, about 1.5 to about 40 mg/kb, about 2 to about 40 mg/kg, about 2.5 to about 40 mg/kg, about 3 to about 40 mg/kg, about 3.5 to about 40 mg/kg, about 4 to about 40 mg/kg, about 4.5 to about 40 mg/kg, about 5 to about 40 mg/kg, about 7.5 to about 40 mg/kg, about 10 to about 40 mg/kg, about 15 to about 40 mg/kg, about 20 to about 40 mg/kg, about 20 to about 40 mg/kg, about 25 to about 40 mg/kg, about 25 to about 40 mg/kg, about 30 to about 40 mg/kg, about 35 to about 40 mg/kg, about 0.1 to about 30 mg/kg, about 0.25 to about 30 mg/kg, about 0.5 to about 30 mg/kg, about 0.75 to about 30 mg/kg, about 1 to about 30 mg/mg, about 1.5 to about 30 mg/kb, about 2 to about 30 mg/kg, about 2.5 to about 30 mg/kg, about 3 to about 30 mg/kg, about 3.5 to about 30 mg/kg, about 4 to about 30 mg/kg, about 4.5 to about 30 mg/kg, about 5 to about 30 mg/kg, about 7.5 to about 30 mg/kg, about 10 to about 30 mg/kg, about 15 to about 30 mg/kg, about 20 to about 30 mg/kg, about 20 to about 30 mg/kg, about 25 to about 30 mg/kg, about 0.1 to about 20 mg/kg, about 0.25 to about 20 mg/kg, about 0.5 to about 20 mg/kg, about 0.75 to about 20 mg/kg, about 1 to about 20 mg/mg, about 1.5 to about 20 mg/kb, about 2 to about 20 mg/kg, about 2.5 to about 20 mg/kg, about 3 to about 20 mg/kg, about 3.5 to about 20 mg/kg, about 4 to about 20 mg/kg, about 4.5 to about 20 mg/kg, about 5 to about 20 mg/kg, about 7.5 to about 20 mg/kg, about 10 to about 20 mg/kg, or about 15 to about 20 mg/kg. Values and ranges intermediate to the recited values are also intended to be part of this invention.

For example, the dsRNA may be administered at a dose of about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, or about 10 mg/kg. Values and ranges intermediate to the recited values are also intended to be part of this invention.

In another embodiment, the dsRNA is administered at a dose of about 0.5 to about 50 mg/kg, about 0.75 to about 50 mg/kg, about 1 to about 50 mg/mg, about 1.5 to about 50 mg/kb, about 2 to about 50 mg/kg, about 2.5 to about 50 mg/kg, about 3 to about 50 mg/kg, about 3.5 to about 50 mg/kg, about 4 to about 50 mg/kg, about 4.5 to about 50 mg/kg, about 5 to about 50 mg/kg, about 7.5 to about 50 mg/kg, about 10 to about 50 mg/kg, about 15 to about 50 mg/kg, about 20 to about 50 mg/kg, about 20 to about 50 mg/kg, about 25 to about 50 mg/kg, about 25 to about 50 mg/kg, about 30 to about 50 mg/kg, about 35 to about 50 mg/kg, about 40 to about 50 mg/kg, about 45 to about 50 mg/kg, about 0.5 to about 45 mg/kg, about 0.75 to about 45 mg/kg, about 1 to about 45 mg/mg, about 1.5 to about 45 mg/kb, about 2 to about 45 mg/kg, about 2.5 to about 45 mg/kg, about 3 to about 45 mg/kg, about 3.5 to about 45 mg/kg, about 4 to about 45 mg/kg, about 4.5 to about 45 mg/kg, about 5 to about 45 mg/kg, about 7.5 to about 45 mg/kg, about 10 to about 45 mg/kg, about 15 to about 45 mg/kg, about 20 to about 45 mg/kg, about 20 to about 45 mg/kg, about 25 to about 45 mg/kg, about 25 to about 45 mg/kg, about 30 to about 45 mg/kg, about 35 to about 45 mg/kg, about 40 to about 45 mg/kg, about 0.5 to about 40 mg/kg, about 0.75 to about 40 mg/kg, about 1 to about 40 mg/mg, about 1.5 to about 40 mg/kb, about 2 to about 40 mg/kg, about 2.5 to about 40 mg/kg, about 3 to about 40 mg/kg, about 3.5 to about 40 mg/kg, about 4 to about 40 mg/kg, about 4.5 to about 40 mg/kg, about 5 to about 40 mg/kg, about 7.5 to about 40 mg/kg, about 10 to about 40 mg/kg, about 15 to about 40 mg/kg, about 20 to about 40 mg/kg, about 20 to about 40 mg/kg, about 25 to about 40 mg/kg, about 25 to about 40 mg/kg, about 30 to about 40 mg/kg, about 35 to about 40 mg/kg, about 0.5 to about 30 mg/kg, about 0.75 to about 30 mg/kg, about 1 to about 30 mg/mg, about 1.5 to about 30 mg/kb, about 2 to about 30 mg/kg, about 2.5 to about 30 mg/kg, about 3 to about 30 mg/kg, about 3.5 to about 30 mg/kg, about 4 to about 30 mg/kg, about 4.5 to about 30 mg/kg, about 5 to about 30 mg/kg, about 7.5 to about 30 mg/kg, about 10 to about 30 mg/kg, about 15 to about 30 mg/kg, about 20 to about 30 mg/kg, about 20 to about 30 mg/kg, about 25 to about 30 mg/kg, about 0.5 to about 20 mg/kg, about 0.75 to about 20 mg/kg, about 1 to about 20 mg/mg, about 1.5 to about 20 mg/kb, about 2 to about 20 mg/kg, about 2.5 to about 20 mg/kg, about 3 to about 20 mg/kg, about 3.5 to about 20 mg/kg, about 4 to about 20 mg/kg, about 4.5 to about 20 mg/kg, about 5 to about 20 mg/kg, about 7.5 to about 20 mg/kg, about 10 to about 20 mg/kg, or about 15 to about 20 mg/kg. In one embodiment, the dsRNA is administered at a dose of about 10 mg/kg to about 30 mg/kg. Values and ranges intermediate to the recited values are also intended to be part of this invention.

For example, subjects can be administered, e.g., subcutaneously or intravenously, a single therapeutic amount of iRNA, such as about 0.1, 0.125, 0.15, 0.175, 0.2, 0.225, 0.25, 0.275, 0.3, 0.325, 0.35, 0.375, 0.4, 0.425, 0.45, 0.475, 0.5, 0.525, 0.55, 0.575, 0.6, 0.625, 0.65, 0.675, 0.7, 0.725, 0.75, 0.775, 0.8, 0.825, 0.85, 0.875, 0.9, 0.925, 0.95, 0.975, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. Values and ranges intermediate to the recited values are also intended to be part of this invention.

In some embodiments, subjects are administered, e.g., subcutaneously or intravenously, multiple doses of a therapeutic amount of iRNA, such as a dose about 0.1, 0.125, 0.15, 0.175, 0.2, 0.225, 0.25, 0.275, 0.3, 0.325, 0.35, 0.375, 0.4, 0.425, 0.45, 0.475, 0.5, 0.525, 0.55, 0.575, 0.6, 0.625, 0.65, 0.675, 0.7, 0.725, 0.75, 0.775, 0.8, 0.825, 0.85, 0.875, 0.9, 0.925, 0.95, 0.975, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. A multi-dose regimine may include administration of a therapeutic amount of iRNA daily, such as for two days, three days, four days, five days, six days, seven days, or longer.

In other embodiments, subjects are administered, e.g., subcutaneously or intravenously, a repeat dose of a therapeutic amount of iRNA, such as a dose about 0.1, 0.125, 0.15, 0.175, 0.2, 0.225, 0.25, 0.275, 0.3, 0.325, 0.35, 0.375, 0.4, 0.425, 0.45, 0.475, 0.5, 0.525, 0.55, 0.575, 0.6, 0.625, 0.65, 0.675, 0.7, 0.725, 0.75, 0.775, 0.8, 0.825, 0.85, 0.875, 0.9, 0.925, 0.95, 0.975, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. A repeat-dose regimine may include administration of a therapeutic amount of iRNA on a regular basis, such as every other day, every third day, every fourth day, twice a week, once a week, every other week, or once a month.

The pharmaceutical composition can be administered by intravenous infusion over a period of time, such as over a 5, 6, 7, 8, 9, 10, 11, 12, 13, 14, 15, 16, 17, 18, 19, 20, and 21, 22, 23, 24, or about a 25 minute period. The administration may be repeated, for example, on a regular basis, such as weekly, biweekly (i.e., every two weeks) for one month, two months, three months, four months or longer. After an initial treatment regimen, the treatments can be administered on a less frequent basis. For example, after administration weekly or biweekly for three months, administration can be repeated once per month, for six months or a year or longer.

The pharmaceutical composition can be administered once daily, or the iRNA can be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

In other embodiments, a single dose of the pharmaceutical compositions can be long lasting, such that subsequent doses are administered at not more than 3, 4, or 5 day intervals, or at not more than 1, 2, 3, or 4 week intervals. In some embodiments of the invention, a single dose of the pharmaceutical compositions of the invention is administered once per week. In other embodiments of the invention, a single dose of the pharmaceutical compositions of the invention is administered bi-monthly.

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

Advances in mouse genetics have generated a number of mouse models for the study of various human diseases, such as a disorder that would benefit from reduction in the expression of C5. Such models can be used for in vivo testing of iRNA, as well as for determining a therapeutically effective dose. Suitable mouse models are known in the art and include, for example, collagen-induced arthritis mouse model (Courtenay, J. S., et al. (1980) *Nature* 283, 666-668), myocardial ischemia (Homeister J W and Lucchesi B R (1994) *Annu Rev Pharmacol Toxicol* 34:17-40), ovalbumin induced asthma mouse models (e.g., Tomkinson A., et al. (2001). *J. Immunol.* 166, 5792-5800), (NZB×NZW)F1, MRL/Fas$^{lpr}$ (MRL/lpr) and BXSB mouse models (Theofilopoulos, A. N. and Kono, D. H. 1999. Murine lupus models: gene-specific and genome-wide studies. In Lahita R. G., ed., *Systemic Lupus Erythematosus,* 3rd edn, p. 145. Academic Press, San Diego, Calif.), mouse aHUS model (Goicoechea de Jorge et al. (2011) *The development of atypical hemolytic uremic syndrome depends on complement C5, J Am Soc Nephrol* 22:137-145.

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver (e.g., the hepatocytes of the liver).

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a C1-20 alkyl ester (e.g., isopropylmyristate IPM), monoglyceride, diglyceride or pharmaceutically acceptable salt thereof). Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate RNAi. In some cases the liposomes are also specifically targeted, e.g., to direct the iRNA to particular cell types.

A liposome containing a RNAi agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The RNAi agent preparation is then added to the micelles that include the lipid component. The cationic groups on the lipid interact with the RNAi agent and condense around the RNAi agent to form a liposome. After condensation, the detergent is removed, e.g., by dialysis, to yield a liposomal preparation of RNAi agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., *Proc. Natl. Acad. Sci., USA* 8:7413-7417, 1987; U.S. Pat. No. 4,897,355; U.S. Pat. No. 5,171,678; Bangham, et al. *M. Mol. Biol.* 23:238, 1965; Olson, et al. *Biochim. Biophys. Acta* 557:9, 1979; Szoka, et al. *Proc. Natl. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986). Microfluidization can be used when consistently small (50 to 200 nm) and relatively uniform aggregates are desired (Mayhew, et al. *Biochim. Biophys. Acta* 775:169, 1984). These methods are readily adapted to packaging RNAi agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively-charged, entrap nucleic acids rather than complex with it. Since both the nucleic acid and the lipid are similarly charged, repulsion rather than complex formation occurs. Nevertheless, some nucleic acid is entrapped within the aqueous interior of these liposomes. pH-sensitive liposomes have been used to deliver nucleic acids encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. No. 5,283,185; U.S. Pat. No. 5,171,678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. *S.T.P. Pharma. Sci.*, 1994, 4(6) 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters*, 1987, 223, 42; Wu et al., *Cancer Research*, 1993, 53, 3765).

Various liposomes comprising one or more glycolipids are known in the art. Papahadjopoulos et al. (*Ann. N.Y. Acad. Sci.*, 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver RNAi agents to macrophages.

Further advantages of liposomes include: liposomes obtained from natural phospholipids are biocompatible and biodegradable; liposomes can incorporate a wide range of water and lipid soluble drugs; liposomes can protect encapsulated RNAi agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxyl)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of RNAi agent (see, e.g., Felgner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer RNAi agent into the skin. In some implementations, liposomes are used for delivering RNAi agent to epidermal cells and also to enhance the penetration of RNAi agent into dermal tissues, e.g., into skin. For example, the liposomes can be applied topically. Topical delivery of drugs formulated as liposomes to the skin has been documented (see, e.g., Weiner et al., Journal of Drug Targeting, 1992, vol. 2, 405-410 and du Plessis et al., Antiviral Research, 18, 1992, 259-265; Mannino, R. J. and Fould-Fogerite, S., Biotechniques 6:682-690, 1988; Itani, T. et al. Gene 56:267-276. 1987; Nicolau, C. et al. Meth. Enz. 149:157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with RNAi agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include RNAi agent can be delivered, for example, subcutaneously by infection in order to deliver RNAi agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in U.S. provisional application Ser. No. 61/018, 616, filed Jan. 2, 2008; 61/018,611, filed Jan. 2, 2008; 61/039, 748, filed Mar. 26, 2008; 61/047,087, filed Apr. 22, 2008 and 61/051,528, filed May 8, 2008. PCT application no PCT/US2007/080331, filed Oct. 3, 2007 also describes formulations that are amenable to the present invention.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in "Pharmaceutical Dosage Forms", Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms", Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAs of in the invention may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N,N-dimethylammonium bromide (DDAB), N—(I-2,3-dioleyloxy)propyl)-N,N,N-trimethylammonium chloride (DOTAP), N—(I-(2,3-dioleyloxyl)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis (2-hydroxydodecyl)amino)ethyl)(2-hydroxydodecyl)amino) ethyl)piperazin-1-yl)ethylazanediyl)didodecan-2-ol (Tech GI), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4- dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see U.S. patent application Ser. No. 12/056,230, filed Mar. 26, 2008, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

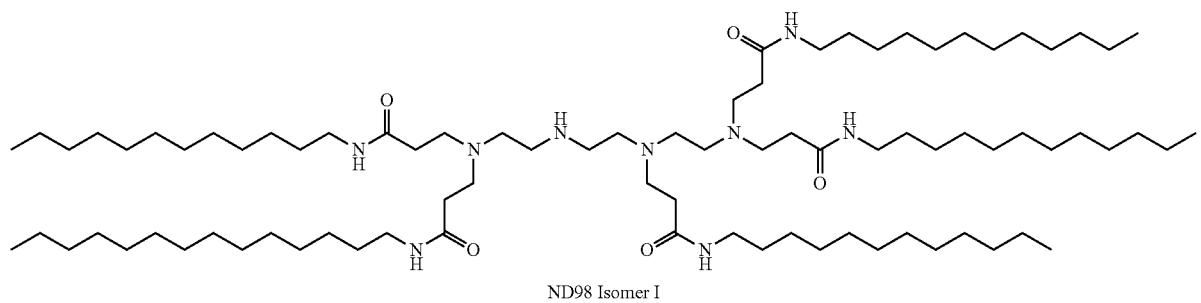

ND98 Isomer I

LNP01 formulations are described, e.g., in International Application Publication No. WO 2008/042973, which is hereby incorporated by reference.

Additional exemplary lipid-dsRNA formulations are described in Table 1.

TABLE 1

|  | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |

TABLE 1-continued

| | Ionizable/Cationic Lipid | cationic lipid/non-cationic lipid/cholesterol/PEG-lipid conjugate Lipid:siRNA ratio |
|---|---|---|
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)
SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.
XTC comprising formulations are described, e.g., in U.S. Provisional Serial No. 61/148,366, filed Jan. 29, 2009; U.S. Provisional Serial No. 61/156,851, filed Mar. 2, 2009; U.S. Provisional Serial No. filed Jun. 10, 2009; U.S. Provisional Serial No. 61/228,373, filed Jul. 24, 2009; U.S. Provisional Serial No. 61/239,686, filed Sep. 3, 2009, and International Application No. PCT/US2010/022614, filed Jan. 29, 2010, which are hereby incorporated by reference.
MC3 comprising formulations are described, e.g., in U.S. Publication No. 2010/0324120, filed Jun. 10, 2010, the entire contents of which are hereby incorporated by reference.
ALNY-100 comprising formulations are described, e.g., International patent application number PCT/US09/63933, filed on Nov. 10, 2009, which is hereby incorporated by reference.
C12-200 comprising formulations are described in U.S. Provisional Serial No. 61/175,770, filed May 5, 2009 and International Application No. PCT/US10/33777, filed May 5, 2010, which are hereby incorporated by reference.

Synthesis of Ionizable/Cationic Lipids

Any of the compounds, e.g., cationic lipids and the like, used in the nucleic acid-lipid particles of the invention can be prepared by known organic synthesis techniques, including the methods described in more detail in the Examples. All substituents are as defined below unless indicated otherwise.

"Alkyl" means a straight chain or branched, noncyclic or cyclic, saturated aliphatic hydrocarbon containing from 1 to 24 carbon atoms. Representative saturated straight chain alkyls include methyl, ethyl, n-propyl, n-butyl, n-pentyl, n-hexyl, and the like; while saturated branched alkyls include isopropyl, sec-butyl, isobutyl, tert-butyl, isopentyl, and the like. Representative saturated cyclic alkyls include cyclopropyl, cyclobutyl, cyclopentyl, cyclohexyl, and the like; while unsaturated cyclic alkyls include cyclopentenyl and cyclohexenyl, and the like.

"Alkenyl" means an alkyl, as defined above, containing at least one double bond between adjacent carbon atoms. Alkenyls include both cis and trans isomers. Representative straight chain and branched alkenyls include ethylenyl, propylenyl, 1-butenyl, 2-butenyl, isobutylenyl, 1-pentenyl, 2-pentenyl, 3-methyl-1-butenyl, 2-methyl-2-butenyl, 2,3-dimethyl-2-butenyl, and the like.

"Alkynyl" means any alkyl or alkenyl, as defined above, which additionally contains at least one triple bond between adjacent carbons. Representative straight chain and branched alkynyls include acetylenyl, propynyl, 1-butynyl, 2-butynyl, 1-pentynyl, 2-pentynyl, 3-methyl-1 butynyl, and the like.

"Acyl" means any alkyl, alkenyl, or alkynyl wherein the carbon at the point of attachment is substituted with an oxo group, as defined below. For example, —C(=O)alkyl, —C(=O)alkenyl, and —C(=O)alkynyl are acyl groups.

"Heterocycle" means a 5- to 7-membered monocyclic, or 7- to 10-membered bicyclic, heterocyclic ring which is either saturated, unsaturated, or aromatic, and which contains from 1 or 2 heteroatoms independently selected from nitrogen, oxygen and sulfur, and wherein the nitrogen and sulfur heteroatoms can be optionally oxidized, and the nitrogen heteroatom can be optionally quaternized, including bicyclic rings in which any of the above heterocycles are fused to a benzene ring. The heterocycle can be attached via any heteroatom or carbon atom. Heterocycles include heteroaryls as defined below. Heterocycles include morpholinyl, pyrrolidinonyl, pyrrolidinyl, piperidinyl, piperizynyl, hydantoinyl, valerolactamyl, oxiranyl, oxetanyl, tetrahydrofuranyl, tetrahydropyranyl, tetrahydropyridinyl, tetrahydroprimidinyl, tetrahydrothiophenyl, tetrahydrothiopyranyl, tetrahydropyrimidinyl, tetrahydrothiophenyl, tetrahydrothiopyranyl, and the like.

The terms "optionally substituted alkyl", "optionally substituted alkenyl", "optionally substituted alkynyl", "optionally substituted acyl", and "optionally substituted heterocycle" means that, when substituted, at least one hydrogen atom is replaced with a substituent. In the case of an oxo substituent (=O) two hydrogen atoms are replaced. In this regard, substituents include oxo, halogen, heterocycle, —CN, —ORx, —NRxRy, —NRxC(=O)Ry, —NRxSO2Ry, —C(=O)Rx, —C(=O)ORx, —C(=O)NRxRy, —SOnRx and —SOnNRxRy, wherein n is 0, 1 or 2, Rx and Ry are the same or different and independently hydrogen, alkyl or heterocycle, and each of said alkyl and heterocycle substituents can be further substituted with one or more of oxo, halogen, —OH, —CN, alkyl, —ORx, heterocycle, —NRxRy, —NRxC(=O)Ry, —NRxSO2Ry, —C(=O)Rx, —C(=O)ORx, —C(=O)NRxRy, —SOnRx and —SOnNRxRy.

"Halogen" means fluoro, chloro, bromo and iodo.

In some embodiments, the methods of the invention can require the use of protecting groups. Protecting group methodology is well known to those skilled in the art (see, for example, Protective Groups in Organic Synthesis, Green, T. W. et al., Wiley-Interscience, New York City, 1999). Briefly, protecting groups within the context of this invention are any group that reduces or eliminates unwanted reactivity of a functional group. A protecting group can be added to a functional group to mask its reactivity during certain reactions and then removed to reveal the original functional group. In some embodiments an "alcohol protecting group" is used. An "alcohol protecting group" is any group which decreases or eliminates unwanted reactivity of an alcohol functional group. Protecting groups can be added and removed using techniques well known in the art.

Synthesis of Formula A

In some embodiments, nucleic acid-lipid particles of the invention are formulated using a cationic lipid of formula A:

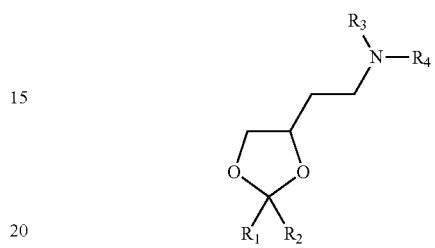

where R1 and R2 are independently alkyl, alkenyl or alkynyl, each can be optionally substituted, and R3 and R4 are independently lower alkyl or R3 and R4 can be taken together to form an optionally substituted heterocyclic ring. In some embodiments, the cationic lipid is XTC (2,2-Dilinoleyl-4-dimethylaminoethyl-[1,3]-dioxolane). In general, the lipid of formula A above can be made by the following Reaction Schemes 1 or 2, wherein all substituents are as defined above unless indicated otherwise.

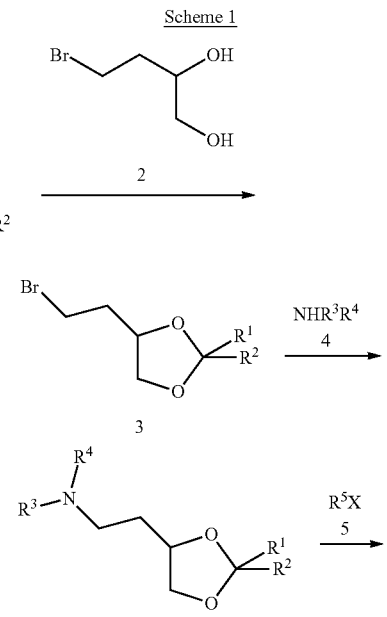

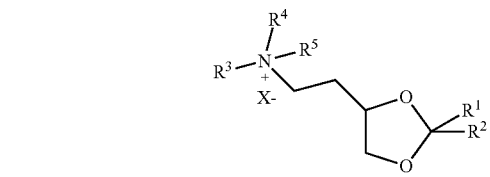

Lipid A, where R1 and R2 are independently alkyl, alkenyl or alkynyl, each can be optionally substituted, and R3 and R4 are independently lower alkyl or R3 and R4 can be taken together to form an optionally substituted heterocyclic ring, can be prepared according to Scheme 1. Ketone 1 and bromide 2 can be purchased or prepared according to methods known to those of ordinary skill in the art. Reaction of 1 and 2 yields ketal 3. Treatment of ketal 3 with amine 4 yields lipids of formula A. The lipids of formula A can be converted to the corresponding ammonium salt with an organic salt of formula 5, where X is anion counter ion selected from halogen, hydroxide, phosphate, sulfate, or the like.

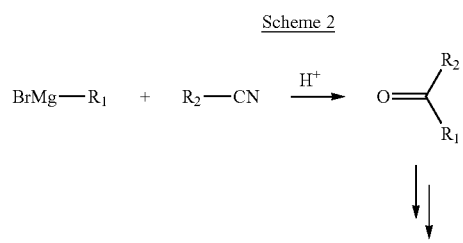

Scheme 2

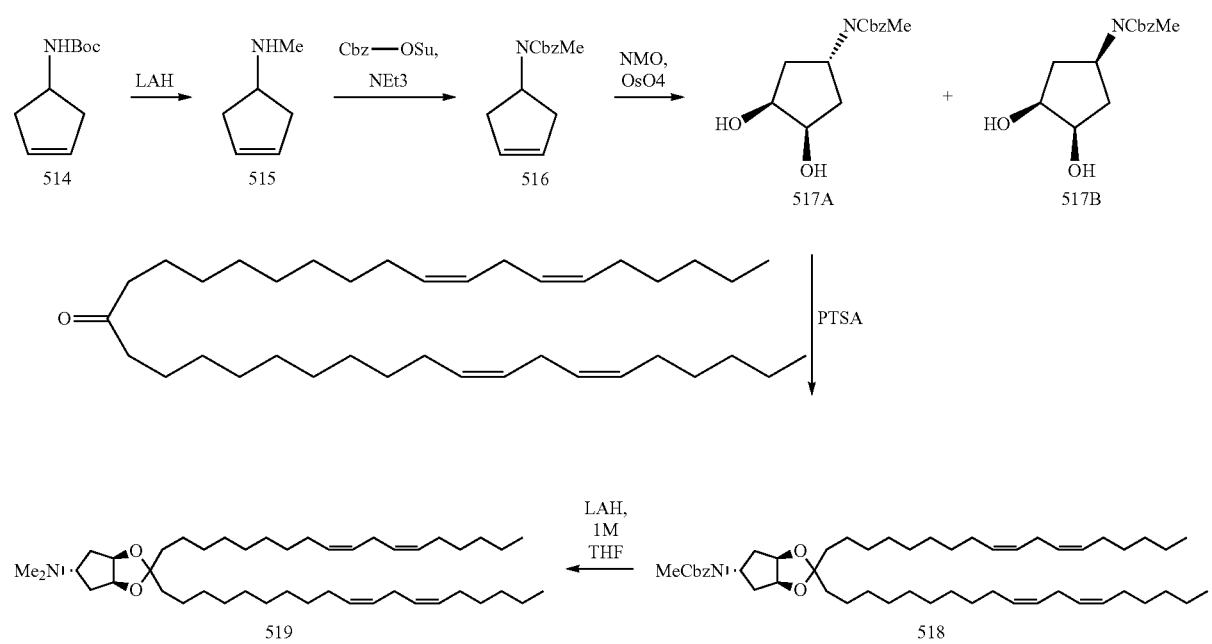

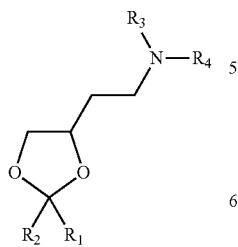

-continued

Alternatively, the ketone 1 starting material can be prepared according to Scheme 2. Grignard reagent 6 and cyanide 7 can be purchased or prepared according to methods known to those of ordinary skill in the art. Reaction of 6 and 7 yields ketone 1. Conversion of ketone 1 to the corresponding lipids of formula A is as described in Scheme 1.

Synthesis of MC3

Preparation of DLin-M-C3-DMA (i.e., (6Z,9Z,28Z,31Z)-heptatriaconta-6,9,28,31-tetraen-19-yl 4-(dimethylamino)butanoate) was as follows. A solution of (6Z,9Z,28Z,31Z)-heptatriaconta-6,9,28,31-tetraen-19-ol (0.53 g), 4-N,N-dimethylaminobutyric acid hydrochloride (0.51 g), 4-N,N-dimethylaminopyridine (0.61 g) and 1-ethyl-3-(3-dimethylaminopropyl)carbodiimide hydrochloride (0.53 g) in dichloromethane (5 mL) was stirred at room temperature overnight. The solution was washed with dilute hydrochloric acid followed by dilute aqueous sodium bicarbonate. The organic fractions were dried over anhydrous magnesium sulphate, filtered and the solvent removed on a rotovap. The residue was passed down a silica gel column (20 g) using a 1-5% methanol/dichloromethane elution gradient.

Fractions containing the purified product were combined and the solvent removed, yielding a colorless oil (0.54 g).

Synthesis of ALNY-100

Synthesis of ketal 519 [ALNY-100] was performed using the following scheme 3:

Synthesis of 515

To a stirred suspension of LiAlH4 (3.74 g, 0.09852 mol) in 200 ml anhydrous THF in a two neck RBF (IL), was added a solution of 514 (10 g, 0.04926 mol) in 70 mL of THF slowly at 0 0 C under nitrogen atmosphere. After complete addition, reaction mixture was warmed to room temperature and then heated to reflux for 4 h. Progress of the reaction was monitored by TLC. After completion of reaction (by TLC) the mixture was cooled to 0 0 C and quenched with careful addition of saturated Na2SO4 solution. Reaction mixture was stirred for 4 h at room temperature and filtered off. Residue was washed well with THF. The filtrate and washings were mixed and diluted with 400 mL dioxane and 26 mL conc. HCl and stirred for 20 minutes at room temperature. The volatilities were stripped off under vacuum to furnish the hydrochloride salt of 515 as a white solid. Yield: 7.12 g 1H-NMR (DMSO, 400 MHz): δ=9.34 (broad, 2H), 5.68 (s, 2H), 3.74 (m, 1H), 2.66-2.60 (m, 2H), 2.50-2.45 (m, 5H).

Synthesis of 516

To a stirred solution of compound 515 in 100 mL dry DCM in a 250 mL two neck RBF, was added NEt3 (37.2 mL, 0.2669 mol) and cooled to 0 0 C under nitrogen atmosphere. After a slow addition of N-(benzyloxy-carbonyloxy)-succinimide (20 g, 0.08007 mol) in 50 mL dry DCM, reaction mixture was allowed to warm to room temperature. After completion of the reaction (2-3 h by TLC) mixture was washed successively with 1N HCl solution (1×100 mL) and saturated NaHCO3 solution (1×50 mL). The organic layer was then dried over anhyd. Na2SO4 and the solvent was evaporated to give crude material which was purified by silica gel column chromatography to get 516 as sticky mass. Yield: 11 g (89%). 1H-NMR (CDCl3, 400 MHz): δ=7.36-7.27 (m, 5H), 5.69 (s, 2H), 5.12 (s, 2H), 4.96 (br., 1H) 2.74 (s, 3H), 2.60 (m, 2H), 2.30-2.25 (m, 2H). LC-MS [M+H]-232.3 (96.94%).

Synthesis of 517A and 517B

The cyclopentene 516 (5 g, 0.02164 mol) was dissolved in a solution of 220 mL acetone and water (10:1) in a single neck 500 mL RBF and to it was added N-methyl morpholine-N-oxide (7.6 g, 0.06492 mol) followed by 4.2 mL of 7.6% solution of OsO4 (0.275 g, 0.00108 mol) in tert-butanol at room temperature. After completion of the reaction (~3 h), the mixture was quenched with addition of solid Na2SO3 and resulting mixture was stirred for 1.5 h at room temperature. Reaction mixture was diluted with DCM (300 mL) and washed with water (2×100 mL) followed by saturated NaHCO3 (1×50 mL) solution, water (1×30 mL) and finally with brine (1×50 mL). Organic phase was dried over an. Na2SO4 and solvent was removed in vacuum. Silica gel column chromatographic purification of the crude material was afforded a mixture of diastereomers, which were separated by prep HPLC. Yield: ~6 g crude 517A—Peak-1 (white solid), 5.13 g (96%). 1H-NMR (DMSO, 400 MHz): δ=7.39-7.31 (m, 5H), 5.04 (s, 2H), 4.78-4.73 (m, 1H), 4.48-4.47 (d, 2H), 3.94-3.93 (m, 2H), 2.71 (s, 3H), 1.72-1.67 (m, 4H). LC-MS—[M+H]-266.3, [M+NH4+]-283.5 present, HPLC-97.86%. Stereochemistry confirmed by X-ray.

Synthesis of 518

Using a procedure analogous to that described for the synthesis of compound 505, compound 518 (1.2 g, 41%) was obtained as a colorless oil. 1H-NMR (CDCl3, 400 MHz): δ=7.35-7.33 (m, 4H), 7.30-7.27 (m, 1H), 5.37-5.27 (m, 8H), 5.12 (s, 2H), 4.75 (m, 1H), 4.58-4.57 (m, 2H), 2.78-2.74 (m, 7H), 2.06-2.00 (m, 8H), 1.96-1.91 (m, 2H), 1.62 (m, 4H), 1.48 (m, 2H), 1.37-1.25 (br m, 36H), 0.87 (m, 6H). HPLC-98.65%.

General Procedure for the Synthesis of Compound 519

A solution of compound 518 (1 eq) in hexane (15 mL) was added in a drop-wise fashion to an ice-cold solution of LAH in THF (1 M, 2 eq). After complete addition, the mixture was heated at 40° C. over 0.5 h then cooled again on an ice bath. The mixture was carefully hydrolyzed with saturated aqueous Na2SO4 then filtered through celite and reduced to an oil. Column chromatography provided the pure 519 (1.3 g, 68%) which was obtained as a colorless oil. 13C NMR 8=130.2, 130.1 (×2), 127.9 (×3), 112.3, 79.3, 64.4, 44.7, 38.3, 35.4, 31.5, 29.9 (×2), 29.7, 29.6 (×2), 29.5 (×3), 29.3 (×2), 27.2 (×3), 25.6, 24.5, 23.3, 226, 14.1; Electrospray MS (+ve): Molecular weight for C44H80NO2 (M+H)+ Calc. 654.6. Found 654.6.

Formulations prepared by either the standard or extrusion-free method can be characterized in similar manners. For example, formulations are typically characterized by visual inspection. They should be whitish translucent solutions free from aggregates or sediment. Particle size and particle size distribution of lipid-nanoparticles can be measured by light scattering using, for example, a Malvern Zetasizer Nano ZS (Malvern, USA). Particles should be about 20-300 nm, such as 40-100 nm in size. The particle size distribution should be unimodal. The total dsRNA concentration in the formulation, as well as the entrapped fraction, is estimated using a dye exclusion assay. A sample of the formulated dsRNA can be incubated with an RNA-binding dye, such as Ribogreen (Molecular Probes) in the presence or absence of a formulation disrupting surfactant, e.g., 0.5% Triton-X100. The total dsRNA in the formulation can be determined by the signal from the sample containing the surfactant, relative to a standard curve. The entrapped fraction is determined by subtracting the "free" dsRNA content (as measured by the signal in the absence of surfactant) from the total dsRNA content. Percent entrapped dsRNA is typically >85%. For SNALP formulation, the particle size is at least 30 nm, at least 40 nm, at least 50 nm, at least 60 nm, at least 70 nm, at least 80 nm, at least 90 nm, at least 100 nm, at least 110 nm, and at least 120 nm. The suitable range is typically about at least 50 nm to about at least 110 nm, about at least 60 nm to about at least 100 nm, or about at least 80 nm to about at least 90 nm.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyomithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

C. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., *Pharmaceutical Research*, 1994, 11, 1385-1390; Ritschel, *Meth. Find. Exp. Clin. Pharmacol.*, 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., *Pharmaceutical Research*, 1994, 11, 1385; Ho et al., *J. Pharm. Sci.*, 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., *Critical Reviews in Therapeutic Drug Carrier Systems*, 1991, p. 92). Each of these classes has been discussed above.

iii. Microparticles an RNAi agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and non-ionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., *J. Pharm. Pharmacol.*, 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_{1-20}$ alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., *J. Pharm. Pharmacol.*, 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., *J. Pharm. Exp. Ther.*, 1992, 263, 25; Yamashita et al., *J. Pharm. Sci.*, 1990, 79, 579-583).

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, *J. Chromatogr.*, 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., *J. Control Rel.*, 1990, 14, 43-51).

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylaza-cyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., *J. Pharm. Pharmacol.*, 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293fectin™ (Invitrogen; Carlsbad, Calif.), Cellfectin™ (Invitrogen; Carlsbad, Calif.), DMRIE-C™ (Invitrogen; Carlsbad, Calif.), FreeStyle™MAX (Invitrogen; Carlsbad, Calif.), Lipofectamine™ 2000 CD (Invitrogen; Carlsbad, Calif.), Lipofectamine™ (Invitrogen; Carlsbad, Calif.), RNAiMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPass$^a$ D1 Transfection Reagent (New England Biolabs; Ipswich, Mass., USA), LyoVec™/LipoGen™ (Invitrogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more agents which function by a non-RNAi mechanism and which are useful in treating a hemolytic disorder. Examples of such agents include, but are not limited to an anti-inflammatory agent, anti-steatosis agent, anti-viral, and/or anti-fibrosis agent. In addition, other substances commonly used to protect the liver, such as silymarin, can also be used in conjunction with the iRNAs described herein. Other agents useful for treating liver diseases include telbivudine, entecavir, and protease inhibitors such as telaprevir and other disclosed, for example, in Tung et al., U.S. Application Publication Nos. 2005/0148548, 2004/0167116, and 2003/0144217; and in Hale et al., U.S. Application Publication No. 2004/0127488.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50 with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by C5 expression. In any event, the administering physician can adjust the amount and timing of iRNA administration on the basis of results observed using standard measures of efficacy known in the art or described herein.

VI. Methods for Inhibiting C5 Expression

The present invention provides methods of inhibiting expression of C5 in a cell. The methods include contacting a cell with an RNAi agent, e.g., a double stranded RNAi agent, in an amount effective to inhibit expression of the C5 in the cell, thereby inhibiting expression of the C5 in the cell.

Contacting of a cell with a double stranded RNAi agent may be done in vitro or in vivo. Contacting a cell in vivo with the RNAi agent includes contacting a cell or group of cells within a subject, e.g., a human subject, with the RNAi agent. Combinations of in vitro and in vivo methods of contacting are also possible. Contacting may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc$_3$ ligand, or any other ligand that directs the RNAi agent to a site of interest, e.g., the liver of a subject.

The term "inhibiting," as used herein, is used interchangeably with "reducing," "silencing," "downregulating" and other similar terms, and includes any level of inhibition.

The phrase "inhibiting expression of a C5" is intended to refer to inhibition of expression of any C5 gene (such as, e.g., a mouse C5 gene, a rat C5 gene, a monkey C5 gene, or a human C5 gene) as well as variants or mutants of a C5 gene. Thus, the C5 gene may be a wild-type C5 gene, a mutant C5 gene, or a transgenic C5 gene in the context of a genetically manipulated cell, group of cells, or organism.

"Inhibiting expression of a C5 gene" includes any level of inhibition of a C5 gene, e.g., at least partial suppression of the expression of a C5 gene. The expression of the C5 gene may be assessed based on the level, or the change in the level, of any variable associated with C5 gene expression, e.g., C5 mRNA level, C5 protein level, or for example, $CH_{50}$ activity as a measure of total hemolytic complement, $AH_{50}$ to measure the hemolytic activity of the alternate pathway of complement, and/or lactate dehydrogenase (LDH) levels as a measure of intravascular hemolysis, and/or hemoglobin levels. Levels of C5a, C5b, and soluble C5b-9 complex may also be measured to assess C5 expression. This level may be assessed in an individual cell or in a group of cells, including, for example, a sample derived from a subject.

Inhibition may be assessed by a decrease in an absolute or relative level of one or more variables that are associated with C5 expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a C5 gene is inhibited by at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

Inhibition of the expression of a C5 gene may be manifested by a reduction of the amount of mRNA expressed by a first cell or group of cells (such cells may be present, for example, in a sample derived from a subject) in which a C5 gene is transcribed and which has or have been treated (e.g., by contacting the cell or cells with an RNAi agent of the invention, or by administering an RNAi agent of the invention to a subject in which the cells are or were present) such that the expression of a C5 gene is inhibited, as compared to a second cell or group of cells substantially identical to the first cell or group of cells but which has not or have not been so treated (control cell(s)). In preferred embodiments, the inhibition is assessed by expressing the level of mRNA in treated cells as a percentage of the level of mRNA in control cells, using the following formula:

$$\frac{\text{(mRNA in control cells)} - \text{(mRNA in treated cells)}}{\text{(mRNA in control cells)}} \cdot 100\%$$

Alternatively, inhibition of the expression of a C5 gene may be assessed in terms of a reduction of a parameter that is functionally linked to C5 gene expression, e.g., C5 protein expression, hepcidin gene or protein expression, or iron levels in tissues or serum. C5 gene silencing may be determined in any cell expressing C5, either constitutively or by genomic engineering, and by any assay known in the art. The liver is the major site of C5 expression. Other significant sites of expression include the kidneys and the uterus.

Inhibition of the expression of a C5 protein may be manifested by a reduction in the level of the C5 protein that is expressed by a cell or group of cells (e.g., the level of protein expressed in a sample derived from a subject). As explained above for the assessment of mRNA suppression, the inhibition of protein expression levels in a treated cell or group of cells may similarly be expressed as a percentage of the level of protein in a control cell or group of cells.

A control cell or group of cells that may be used to assess the inhibition of the expression of a C5 gene includes a cell or group of cells that has not yet been contacted with an RNAi agent of the invention. For example, the control cell or group of cells may be derived from an individual subject (e.g., a human or animal subject) prior to treatment of the subject with an RNAi agent.

The level of C5 mRNA that is expressed by a cell or group of cells may be determined using any method known in the art for assessing mRNA expression. In one embodiment, the level of expression of C5 in a sample is determined by detecting a transcribed polynucleotide, or portion thereof, e.g., mRNA of the C5 gene. RNA may be extracted from cells using RNA extraction techniques including, for example, using acid phenol/guanidine isothiocyanate extraction (RNAzol B; Biogenesis), RNeasy RNA preparation kits (Qiagen) or PAXgene (PreAnalytix, Switzerland). Typical assay formats utilizing ribonucleic acid hybridization include nuclear run-on assays, RT-PCR, RNase protection assays (Melton et al., *Nuc. Acids Res.* 12:7035), Northern blotting, in situ hybridization, and microarray analysis.

In one embodiment, the level of expression of C5 is determined using a nucleic acid probe. The term "probe", as used herein, refers to any molecule that is capable of selectively binding to a specific C5. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or Northern analyses, polymerase chain reaction (PCR) analyses and probe arrays. One method for the determination of mRNA levels involves contacting the isolated mRNA with a nucleic acid molecule (probe) that can hybridize to C5 mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of C5 mRNA.

An alternative method for determining the level of expression of C5 in a sample involves the process of nucleic acid amplification and/or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of C5 is determined by quantitative fluorogenic RT-PCR (i.e., the TaqMan™ System).

The expression levels of C5 mRNA may be monitored using a membrane blot (such as used in hybridization analysis such as Northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of C5 expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein.

The level of C5 protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, Western blotting, radioimmunoassay (RIA), enzyme-linked immunosorbent assays (ELISAs), immunofluorescent assays, electrochemiluminescence assays, and the like.

The term "sample" as used herein refers to a collection of similar fluids, cells, or tissues isolated from a subject, as well as fluids, cells, or tissues present within a subject. Examples of biological fluids include blood, serum and serosal fluids, plasma, lymph, urine, cerebrospinal fluid, saliva, ocular fluids, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In preferred embodiments, a "sample derived from a subject" refers to blood or plasma drawn from the subject. In further embodiments, a "sample derived from a subject" refers to liver tissue derived from the subject.

In some embodiments of the methods of the invention, the RNAi agent is administered to a subject such that the RNAi agent is delivered to a specific site within the subject. The inhibition of expression of C5 may be assessed using measurements of the level or change in the level of C5 mRNA or C5 protein in a sample derived from fluid or tissue from the specific site within the subject. In preferred embodiments, the site is the liver. The site may also be a subsection or subgroup of cells from any one of the aforementioned sites. The site may also include cells that express a particular type of receptor.

The phrase "contacting a cell with an RNAi agent," such as a dsRNA, as used herein, includes contacting a cell by any possible means. Contacting a cell with an RNAi agent includes contacting a cell in vitro with the iRNA or contacting a cell in vivo with the iRNA. The contacting may be done directly or indirectly. Thus, for example, the RNAi agent may be put into physical contact with the cell by the individual performing the method, or alternatively, the RNAi agent may be put into a situation that will permit or cause it to subsequently come into contact with the cell.

Contacting a cell in vitro may be done, for example, by incubating the cell with the RNAi agent. Contacting a cell in vivo may be done, for example, by injecting the RNAi agent into or near the tissue where the cell is located, or by injecting the RNAi agent into another area, e.g., the bloodstream or the subcutaneous space, such that the agent will subsequently reach the tissue where the cell to be contacted is located. For example, the RNAi agent may contain and/or be coupled to a ligand, e.g., GalNAc3, that directs the RNAi agent to a site of interest, e.g., the liver. Combinations of in vitro and in vivo methods of contacting are also possible. For example, a cell may also be contacted in vitro with an RNAi agent and subsequently transplanted into a subject.

In one embodiment, contacting a cell with an iRNA includes "introducing" or "delivering the iRNA into the cell" by facilitating or effecting uptake or absorption into the cell. Absorption or uptake of an iRNA can occur through unaided diffusive or active cellular processes, or by auxiliary agents or devices. Introducing an iRNA into a cell may be in vitro and/or in vivo. For example, for in vivo introduction, iRNA can be injected into a tissue site or administered systemically. In vivo delivery can also be done by a beta-glucan delivery system, such as those described in U.S. Pat. Nos. 5,032,401 and 5,607,677, and U.S. Publication No. 2005/0281781, the entire contents of which are hereby incorporated herein by reference. In vitro introduction into a cell includes methods known in the art such as electroporation and lipofection. Further approaches are described herein below and/or are known in the art.

VII. Methods for Treating or Preventing a Complement Component C5-Associated Disorder The present invention also provides therapeutic and prophylactic methods which include administering to a subject having a complement component C5-associated disease, e.g., PNH or aHUS, an iRNA agent, pharmaceutical compositions comprising an iRNA agent, or vector comprising an iRNA of the invention. In some aspects of the invention, the methods further include administering to the subject an additional therapeutic agent, such as an anti-complement component C5 antibody, or antigen-binding fragment thereof (e.g., eculizumab).

In one aspect, the present invention provides methods of treating a subject having a disorder that would benefit from reduction in C5 expression, e.g., a complement component C5-associated disease, e.g., PNH or aHUS. The treatment methods (and uses) of the invention include administering to the subject, e.g., a human, a therapeutically effective amount of an iRNA agent targeting a C5 gene or a pharmaceutical composition comprising an iRNA agent targeting a C5 gene, thereby treating the subject having a disorder that would benefit from reduction in C5 expression.

In another aspect, the present invention provides methods of treating a subject having a disorder that would benefit from reduction in C5 expression, e.g., a complement component C5-associated disease, e.g., PNH or aHUS, which include administering to the subject, e.g., a human, a therapeutically effective amount of an iRNA agent targeting a C5 gene or a pharmaceutical composition comprising an iRNA agent targeting a C5 gene, and an additional therapeutic agent, such as an anti-complement component C5 antibody, or antigen-binding fragment thereof (e.g., eculizumab), thereby treating the subject having a disorder that would benefit from reduction in C5 expression.

In one aspect, the invention provides methods of preventing at least one symptom in a subject having a disorder that would benefit from reduction in C5 expression, e.g., a complement component C5-associated disease, e.g., PNH or aHUS. The methods include administering to the subject a prohpylactically effective amount of the iRNA agent, e.g., dsRNA, or vector of the invention, thereby preventing at least one symptom in the subject having a disorder that would benefit from reduction in C5 expression. For example, the invention provides methods for preventing hemolysis in a subject suffering from a disorder that would benefit from reduction in C5 expression, e.g., a complement component C5-associated disease, e.g., PNH or aHUS.

In another aspect, the invention provides methods of preventing at least one symptom in a subject having a disorder that would benefit from reduction in C5 expression, e.g., a complement component C5-associated disease, e.g., PNH or aHUS. The methods include administering to the subject a prohpylactically effective amount of the iRNA agent, e.g., dsRNA, or vector of the invention, and an additional therapeutic agent, such as an anti-complement component C5 antibody, or antigen-binding fragment thereof (e.g., eculizumab), thereby preventing at least one symptom in the subject having a disorder that would benefit from reduction in C5 expression.

"Therapeutically effective amount," as used herein, is intended to include the amount of an RNAi agent or anti-complement component C5 antibody, or antigen-binding fragment thereof (e.g., eculizumab), that, when administered to a subject having a complement component C5-associated disease, is sufficient to effect treatment of the disease (e.g., by diminishing, ameliorating or maintaining the existing disease or one or more symptoms of disease). The "therapeutically effective amount" may vary depending on the RNAi agent or antibody, or antigen-binding fragment thereof, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an iRNA agent or anti-complement component C5 antibody, or antigen-binding fragment thereof (e.g., eculizumab), that, when administered to a subject having a complement component C5-associate disease but not yet (or currently) experiencing or displaying symptoms of the disease, and/or a subject at risk of developing a complement component C5-associated disease, e.g., a subject having a graft and/or transplant, e.g., a sensitized or allogenic recipient, a subject having sepsis, and/or a subject having a myocardial infarction, is sufficient to prevent or ameliorate the disease or one or more symptoms of the disease. Ameliorating the disease includes slowing the course of the disease or reducing the severity of later-developing disease. The "prophylactically effective amount" may vary depending on the iRNA agent or anti-complement component C5 antibody, or antigen-binding fragment thereof, how the agent or anti-complement component C5 antibody, or antigen-binding fragment thereof, is administered, the degree of risk of disease, and the history, age, weight, family history, genetic makeup, the types of preceding or concomitant treatments, if any, and other individual characteristics of the patient to be treated.

A "therapeutically effective amount" or "prophylactically effective amount" also includes an amount of an RNAi agent or anti-complement component C5 antibody, or antigen-binding fragment thereof (e.g., eculizumab), that produces some desired local or systemic effect at a reasonable benefit/risk ratio applicable to any treatment. iRNA agents employed in the methods of the present invention may be administered in a sufficient amount to produce a reasonable benefit/risk ratio applicable to such treatment.

In another aspect, the present invention provides uses of a therapeutically effective amount of an iRNA agent of the invention for treating a subject, e.g., a subject that would benefit from a reduction and/or inhibition of C5 expression.

In another aspect, the present invention provides uses of a therapeutically effective amount of an iRNA agent of the invention and an additional therapeutic agent, such as an anti-complement component C5 antibody, or antigen-binding fragment thereof (e.g., eculizumab), for treating a subject, e.g., a subject that would benefit from a reduction and/or inhibition of C5 expression.

In yet another aspect, the present invention provides use of an iRNA agent, e.g., a dsRNA, of the invention targeting a C5 gene or a pharmaceutical composition comprising an iRNA agent targeting a C5 gene in the manufacture of a medicament for treating a subject, e.g., a subject that would benefit from a reduction and/or inhibition of C5 expression, such as a subject having a disorder that would benefit from reduction in C5 expression, e.g., a complement component C5-associated disease, e.g., PNH or aHUS.

In another aspect, the present invention provides uses of an iRNA agent, e.g., a dsRNA, of the invention targeting a C5 gene or a pharmaceutical composition comprising an iRNA agent targeting a C5 gene in the manufacture of a medicament for use in combination with an additional therapeutic agent, such as an anti-complement component C5 antibody, or antigen-binding fragment thereof (e.g., eculizumab), for treating a subject, e.g., a subject that would benefit from a reduction and/or inhibition of C5 expression, e.g., a complement component C5-associated disease, e.g., PNH or aHUS.

In another aspect, the invention provides uses of an iRNA, e.g., a dsRNA, of the invention for preventing at least one symptom in a subject suffering from a disorder that would benefit from a reduction and/or inhibition of C5 expression, such as a complement component C5-associated disease, e.g., PNH or aHUS.

In yet another aspect, the invention provides uses of an iRNA agent, e.g., a dsRNA, of the invention, and an additional therapeutic agent, such as an anti-complement component C5 antibody, or antigen-binding fragment thereof (e.g., eculizumab), for preventing at least one symptom in a subject suffering from a disorder that would benefit from a reduction and/or inhibition of C5 expression, such as a complement component C5-associated disease, e.g., PNH or aHUS.

In a further aspect, the present invention provides uses of an iRNA agent of the invention in the manufacture of a medicament for preventing at least one symptom in a subject suffering from a disorder that would benefit from a reduction and/or inhibition of C5 expression, such as a a complement component C5-associated disease, e.g., PNH or aHUS.

In a further aspect, the present invention provides uses of an iRNA agent of the invention in the manufacture of a medicament for use in combination with an additional therapeutic agent, such as an anti-complement component C5 antibody, or antigen-binding fragment thereof (e.g., eculizumab), for preventing at least one symptom in a subject suffering from a disorder that would benefit from a reduction and/or inhibition of C5 expression, such as a complement component C5-associated disease, e.g., PNH or aHUS.

In one embodiment, an iRNA agent targeting C5 is administered to a subject having a complement component C5-associated disease such that C5 levels, e.g., in a cell, tissue, blood, urine or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more and, subsequently, an additional therapeutic (as described below) is administered to the subject.

The additional therapeutic may be an anti-complement component C5 antibody, or antigen-binding fragment or derivative thereof. In one embodiment, the anti-complement component C5 antibody is eculizumab (SOLIRIS®), or antigen-binding fragment or derivative thereof. Eculizumab is a humanized monoclonal IgG2/4, kappa light chain antibody that specifically binds complement component C5 with high affinity and inhibits cleavage of C5 to C5a and C5b, thereby inhibiting the generation of the terminal complement complex C5b-9. Eculizumab is described in U.S. Pat. No. 6,355, 245, the entire contents of which are incorporated herein by reference.

The methods of the invention comprising administration of an iRNA agent of the invention and eculizumab to a subject may further comprise administration of a meningococcal vaccine to the subject.

The additional therapeutic, e.g., eculizumab and/or a meningococcal vaccine, may be administered to the subject at the same time as the iRNA agent targeting C5 or at a different time.

Moreover, the additional therapeutic, e.g., eculizumab, may be administered to the subject in the same formulation as the iRNA agent targeting C5 or in a different formulation as the iRNA agent targeting C5.

Eculizumab dosage regimens are described in, for example, the product insert for eculizumab (SOLIRIS®) and in U.S. Patent Application No. 2012/0225056, the entire contents of each of which are incorporated herein by reference. In exemplary methods of the invention for treating a complement component C5-associated disease, e.g., PNH or aHUS, an iRNA agent targeting C5 is administered (e.g., subcutaneously) to the subject first, such that the C5 levels in the subject are reduced (e.g., by at least about 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more) and subsequently eculizumab is administered at doses lower than the ones described in the product insert for SOLIRIS®. For example, eculizumab may be administered to the subject weekly at a dose less than about 600 mg for 4 weeks followed by a fifth dose at about one week later of less than about 900 mg, followed by a dose less than about 900 mg about every two weeks thereafter. Eculizumab may also be administered to the subject weekly at a dose less than about 900 mg for 4 weeks followed by a fifth dose at about one week later of less than about 1200 mg, followed by a dose less than about 1200 mg about every two weeks thereafter. If the subject is less than 18 years of age, eculizumab may be administered to the subject weekly at a dose less than about 900 mg for 4 weeks followed by a fifth dose at about one week later of less than about 1200 mg, followed by a dose less than about 1200 mg about every two weeks thereafter; or if the subject is less than 18 years of age, eculizumab may be administered to the subject weekly at a dose less than about 600 mg for 2 weeks followed by a third dose at about one week later of less than about 900 mg, followed by a dose less than about 900 mg about every two weeks thereafter; or if the subject is less than 18 years of age, eculizumab may be administered to the subject weekly at a dose less than about 600 mg for 2 weeks followed by a third dose at about one week later of less than about 600 mg, followed by a dose less than about 600 mg about every two weeks thereafter; or if the subject is less than 18 years of age, eculizumab may be administered to the subject weekly at a dose less than about 600 mg for 1 week followed by a second dose at about one week later of less than about 300 mg, followed by a dose less than about 300 mg about every two weeks thereafter; or if the subject is less than 18 years of age, eculizumab may be administered to the subject weekly at a dose less than about 300 mg for 1 week followed by a second dose at about one week later of less than about 300 mg, followed by a dose less than about 300 mg about every two weeks thereafter. If the subject is receiving plamapheresis or plasma exchange, eculizumab may be administered to the subject at a dose less than about 300 mg (e.g., if the most recent does of eculizumab was about 300 mg) or less than about 600 mg (e.g., if the most recent does of eculizumab was about 600 mg or more). If the subject is receiving plasma infusion, eculizumab may be administered to the subject at a dose less than about 300 mg (e.g., if the most recent does of eculizumab was about 300 mg or more). The lower doses of eculizumab allow for either subcutaneous or intravenous administration of eculizumab.

In the combination therapies of the present invention comprising eculizumab, eculizumab may be administered to the subject, e.g., subcutaneously, at a dose of about 0.01 mg/kg to about 10 mg/kg, or about 5 mg/kg to about 10 mg/kg, or about 0.5 mg/kg to about 15 mg/kg. For example, eculizumab may be administered to the subject, e.g., subcutaneously, at a dose of 0.5 mg/kg, 1 mg/kg, 1.5 mg/kg, 2 mg/kg, 2.5 mg/kg, 3 mg/kg, 3.5 mg/kg, 4 mg/kg, 4.5 mg/kg, 5 mg/kg, 5.5 mg/kg, 6 mg/kg, 6.5 mg/kg, 7 mg/kg, 7.5 mg/kg, 8 mg/kg, 8.5 mg/kg, 9 mg/kg, 9.5 mg/kg, 10 mg/kg, 10.5 mg/kg, 11 mg/kg, 11.5 mg/kg, 12 mg/kg, 12.5 mg/kg, 13 mg/kg, 13.5 mg/kg, 14 mg/kg, 14.5 mg/kg, or 15 mg/kg.

The methods and uses of the invention include administering a composition described herein such that expression of the target C5 gene is decreased, such as for about 1, 2, 3, 4, 5, 6, 7, 8, 12, 16, 18, 24, 28, 32, 36, 40, 44, 48, 52, 56, 60, 64, 68, 72, 76, or about 80 hours. In one embodiment, expression of the target C5 gene is decreased for an extended duration, e.g., at least about two, three, four, five, six, seven days or more, e.g., about one week, two weeks, three weeks, or about four weeks or longer.

Administration of the dsRNA according to the methods and uses of the invention may result in a reduction of the severity, signs, symptoms, and/or markers of such diseases or disorders in a patient with a complement component C5-associated disease. By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of a hemolytic disorder may be assessed, for example, by periodic monitoring of LDH and $CH_{50}$ levels. Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA targeting C5 or pharmaceutical composition thereof, "effective against" a complement component C5-associated disease indicates that administration in a clinically appropriate manner results in a beneficial effect for at least a statistically significant fraction of patients, such as improvement of symptoms, a cure, a reduction in disease, extension of life, improvement in quality of life, or other effect generally recognized as positive by medical doctors familiar with treating a complement component C5-associated disease and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale, as but one example the Rheumatoid Arthritis Severity Scale (RASS). Any positive change resulting in e.g., lessening of severity of disease measured using the appropriate scale, represents adequate treatment using an iRNA or iRNA formulation as described herein.

Subjects can be administered a therapeutic amount of iRNA, such as about 0.01 mg/kg, 0.02 mg/kg, 0.03 mg/kg, 0.04 mg/kg, 0.05 mg/kg, 0.1 mg/kg, 0.15 mg/kg, 0.2 mg/kg, 0.25 mg/kg, 0.3 mg/kg, 0.35 mg/kg, 0.4 mg/kg, 0.45 mg/kg, 0.5 mg/kg, 0.55 mg/kg, 0.6 mg/kg, 0.65 mg/kg, 0.7 mg/kg, 0.75 mg/kg, 0.8 mg/kg, 0.85 mg/kg, 0.9 mg/kg, 0.95 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.1 mg/kg, 2.2 mg/kg, 2.3 mg/kg, 2.4 mg/kg, 2.5 mg/kg dsRNA, 2.6 mg/kg dsRNA, 2.7 mg/kg dsRNA, 2.8 mg/kg dsRNA, 2.9 mg/kg dsRNA, 3.0 mg/kg dsRNA, 3.1 mg/kg dsRNA, 3.2 mg/kg dsRNA, 3.3 mg/kg dsRNA, 3.4 mg/kg dsRNA, 3.5 mg/kg dsRNA, 3.6 mg/kg dsRNA, 3.7 mg/kg dsRNA, 3.8 mg/kg dsRNA, 3.9 mg/kg dsRNA, 4.0 mg/kg dsRNA, 4.1 mg/kg dsRNA, 4.2 mg/kg dsRNA, 4.3 mg/kg dsRNA, 4.4 mg/kg dsRNA, 4.5 mg/kg dsRNA, 4.6 mg/kg dsRNA, 4.7 mg/kg dsRNA, 4.8 mg/kg dsRNA, 4.9 mg/kg dsRNA, 5.0 mg/kg dsRNA, 5.1 mg/kg dsRNA, 5.2 mg/kg dsRNA, 5.3 mg/kg dsRNA, 5.4 mg/kg dsRNA, 5.5 mg/kg dsRNA, 5.6 mg/kg dsRNA, 5.7 mg/kg dsRNA, 5.8 mg/kg dsRNA, 5.9 mg/kg dsRNA, 6.0 mg/kg dsRNA, 6.1 mg/kg dsRNA, 6.2 mg/kg dsRNA, 6.3 mg/kg dsRNA, 6.4 mg/kg dsRNA, 6.5 mg/kg dsRNA, 6.6 mg/kg dsRNA, 6.7 mg/kg dsRNA, 6.8 mg/kg dsRNA, 6.9 mg/kg dsRNA, 7.0 mg/kg dsRNA, 7.1 mg/kg dsRNA, 7.2 mg/kg dsRNA, 7.3 mg/kg dsRNA, 7.4 mg/kg dsRNA, 7.5 mg/kg dsRNA, 7.6 mg/kg dsRNA, 7.7 mg/kg dsRNA, 7.8 mg/kg dsRNA, 7.9 mg/kg dsRNA, 8.0 mg/kg dsRNA, 8.1 mg/kg dsRNA, 8.2 mg/kg dsRNA, 8.3 mg/kg dsRNA, 8.4 mg/kg dsRNA, 8.5 mg/kg dsRNA, 8.6 mg/kg dsRNA, 8.7 mg/kg dsRNA, 8.8 mg/kg dsRNA, 8.9 mg/kg dsRNA, 9.0 mg/kg dsRNA, 9.1 mg/kg dsRNA, 9.2 mg/kg dsRNA, 9.3 mg/kg dsRNA, 9.4 mg/kg dsRNA, 9.5 mg/kg dsRNA, 9.6 mg/kg dsRNA, 9.7 mg/kg dsRNA, 9.8 mg/kg dsRNA, 9.9 mg/kg dsRNA, 9.0 mg/kg dsRNA, 10 mg/kg dsRNA, 15 mg/kg dsRNA, 20 mg/kg dsRNA, 25 mg/kg dsRNA, 30 mg/kg dsRNA, 35 mg/kg dsRNA, 40 mg/kg dsRNA, 45 mg/kg dsRNA, or about 50 mg/kg dsRNA. Values and ranges intermediate to the recited values are also intended to be part of this invention.

In certain embodiments, for example, when a composition of the invention comprises a dsRNA as described herein and a lipid, subjects can be administered a therapeutic amount of iRNA, such as about 0.01 mg/kg to about 5 mg/kg, about 0.01 mg/kg to about 10 mg/kg, about 0.05 mg/kg to about 5 mg/kg, about 0.05 mg/kg to about 10 mg/kg, about 0.1 mg/kg to about 5 mg/kg, about 0.1 mg/kg to about 10 mg/kg, about 0.2 mg/kg to about 5 mg/kg, about 0.2 mg/kg to about 10 mg/kg, about 0.3 mg/kg to about 5 mg/kg, about 0.3 mg/kg to about 10 mg/kg, about 0.4 mg/kg to about 5 mg/kg, about 0.4 mg/kg to about 10 mg/kg, about 0.5 mg/kg to about 5 mg/kg, about 0.5 mg/kg to about 10 mg/kg, about 1 mg/kg to about 5 mg/kg, about 1 mg/kg to about 10 mg/kg, about 1.5 mg/kg to about 5 mg/kg, about 1.5 mg/kg to about 10 mg/kg, about 2 mg/kg to about 2.5 mg/kg, about 2 mg/kg to about 10 mg/kg, about 3 mg/kg to about 5 mg/kg, about 3 mg/kg to about 10 mg/kg, about 3.5 mg/kg to about 5 mg/kg, about 4 mg/kg to about 5 mg/kg, about 4.5 mg/kg to about 5 mg/kg, about 4 mg/kg to about 10 mg/kg, about 4.5 mg/kg to about 10 mg/kg, about 5 mg/kg to about 10 mg/kg, about 5.5 mg/kg to about 10 mg/kg, about 6 mg/kg to about 10 mg/kg, about 6.5 mg/kg to about 10 mg/kg, about 7 mg/kg to about 10 mg/kg, about 7.5 mg/kg to about 10 mg/kg, about 8 mg/kg to about 10 mg/kg, about 8.5 mg/kg to about 10 mg/kg, about 9 mg/kg to about 10 mg/kg, or about 9.5 mg/kg to about 10 mg/kg. Values and ranges intermediate to the recited values are also intended to be part of this invention.

For example, the dsRNA may be administered at a dose of about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, or about 10 mg/kg. Values and ranges intermediate to the recited values are also intended to be part of this invention.

In other embodiments, for example, when a composition of the invention comprises a dsRNA as described herein and an N-acetylgalactosamine, subjects can be administered a therapeutic amount of iRNA, such as a dose of about 0.1 to about 50 mg/kg, about 0.25 to about 50 mg/kg, about 0.5 to about 50 mg/kg, about 0.75 to about 50 mg/kg, about 1 to about 50 mg/mg, about 1.5 to about 50 mg/kb, about 2 to about 50 mg/kg, about 2.5 to about 50 mg/kg, about 3 to about 50 mg/kg, about 3.5 to about 50 mg/kg, about 4 to about 50 mg/kg, about 4.5 to about 50 mg/kg, about 5 to about 50 mg/kg, about 7.5 to about 50 mg/kg, about 10 to about 50 mg/kg, about 15 to about 50 mg/kg, about 20 to about 50 mg/kg, about 20 to about 50 mg/kg, about 25 to about 50 mg/kg, about 25 to about 50 mg/kg, about 30 to about 50 mg/kg, about 35 to about 50 mg/kg, about 40 to about 50 mg/kg, about 45 to about 50 mg/kg, about 0.1 to about 45 mg/kg, about 0.25 to about 45 mg/kg, about 0.5 to about 45 mg/kg, about 0.75 to about 45 mg/kg, about 1 to about 45 mg/mg, about 1.5 to about 45 mg/kb, about 2 to about 45 mg/kg, about 2.5 to about 45 mg/kg, about 3 to about 45 mg/kg, about 3.5 to about 45 mg/kg, about 4 to about 45 mg/kg, about 4.5 to about 45 mg/kg, about 5 to about 45 mg/kg, about 7.5 to about 45 mg/kg, about 10 to about 45 mg/kg, about 15 to about 45 mg/kg, about 20 to about 45 mg/kg, about 20 to about 45 mg/kg, about 25 to about 45 mg/kg, about 25 to about 45 mg/kg, about 30 to about 45 mg/kg, about 35 to about 45 mg/kg, about 40 to about 45 mg/kg, about 0.1 to about 40 mg/kg, about 0.25 to about 40 mg/kg, about 0.5 to about 40 mg/kg, about 0.75 to about 40 mg/kg, about 1 to about 40 mg/mg, about 1.5 to about 40 mg/kb, about 2 to about 40 mg/kg, about 2.5 to about 40 mg/kg, about 3 to about 40 mg/kg, about 3.5 to about 40 mg/kg, about 4 to about 40 mg/kg, about 4.5 to about 40 mg/kg, about 5 to about 40 mg/kg, about 7.5 to about 40 mg/kg, about 10 to about 40 mg/kg, about 15 to about 40 mg/kg, about 20 to about 40 mg/kg, about 20 to about 40 mg/kg, about 25 to about 40 mg/kg, about 25 to about 40 mg/kg, about 30 to about 40 mg/kg, about 35 to about 40 mg/kg, about 0.1 to about 30 mg/kg, about 0.25 to about 30 mg/kg, about 0.5 to about 30 mg/kg, about 0.75 to about 30 mg/kg, about 1 to about 30 mg/mg, about 1.5 to about 30 mg/kb, about 2 to about 30 mg/kg, about 2.5 to about 30 mg/kg, about 3 to about 30 mg/kg, about 3.5 to about 30 mg/kg, about 4 to about 30 mg/kg, about 4.5 to about 30 mg/kg, about 5 to about 30 mg/kg, about 7.5 to about 30 mg/kg, about 10 to about 30 mg/kg, about 15 to about 30 mg/kg, about 20 to about 30 mg/kg, about 20 to about 30 mg/kg, about 25 to about 30 mg/kg, about 0.1 to about 20 mg/kg, about 0.25 to about 20 mg/kg, about 0.5 to about 20 mg/kg, about 0.75 to about 20 mg/kg, about 1 to about 20 mg/mg, about 1.5 to about 20 mg/kb, about 2 to about 20 mg/kg, about 2.5 to about 20 mg/kg, about 3 to about 20 mg/kg, about 3.5 to about 20 mg/kg, about 4 to about 20 mg/kg, about 4.5 to about 20 mg/kg, about 5 to about 20 mg/kg, about 7.5 to about 20 mg/kg, about 10 to about 20 mg/kg, or about 15 to about 20 mg/kg. In one embodiment, when a composition of the invention comprises a dsRNA as described herein and an N-acetylgalactosamine, subjects can be administered a therapeutic amount of about 10 to about 30 mg/kg of dsRNA. Values and ranges intermediate to the recited values are also intended to be part of this invention.

For example, subjects can be administered a therapeutic amount of iRNA, such as about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. Values and ranges intermediate to the recited values are also intended to be part of this invention.

The iRNA can be administered by intravenous infusion over a period of time, such as over a 5, 6, 7, 8, 9, 10, 11, 12, 13, 14, 15, 16, 17, 18, 19, 20, 21, 22, 23, 24, or about a 25 minute period. The administration may be repeated, for example, on a regular basis, such as weekly, biweekly (i.e., every two weeks) for one month, two months, three months, four months or longer. After an initial treatment regimen, the treatments can be administered on a less frequent basis. For example, after administration weekly or biweekly for three months, administration can be repeated once per month, for six months or a year or longer.

Administration of the iRNA can reduce C5 levels, e.g., in a cell, tissue, blood, urine or other compartment of the patient by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more.

Before administration of a full dose of the iRNA, patients can be administered a smaller dose, such as a 5% infusion, and monitored for adverse effects, such as an allergic reaction. In another example, the patient can be monitored for unwanted immunostimulatory effects, such as increased cytokine (e.g., TNF-alpha or INF-alpha) levels.

Owing to the inhibitory effects on C5 expression, a composition according to the invention or a pharmaceutical composition prepared therefrom can enhance the quality of life.

An iRNA of the invention may be administered in "naked" form, or as a "free iRNA." A naked iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction and/or inhibition of C5 gene expression are those having a complement component C5-associated disease or disorder as described herein. In one embodiment, a subject having a complement component C5-associated disease has paroxysmal nocturnal hemoglobinuria (PNH). In another embodiment, a subject having a complement component C5-associated disease has asthma. In another embodiment, a subject having a complement component C5-associated disease has rheumatoid arthritis. In yet another embodiment, a subject having a complement component C5-associated disease has systemic lupus erythmatosis. In one embodiment, a subject having a complement component C5-associated disease has glomerulonephritis. In another embodiment, a subject having a complement component C5-associated disease has psoriasis. In yet another embodiment, a subject having a complement component C5-associated disease has dermatomyositis bullous pemphigoid. In one embodiment, a subject having a complement component C5-associated disease has atypical hemolytic uremic syndrome. In another embodiment, a subject having a complement component C5-associated disease has Shiga toxin *E. coli*-related hemolytic uremic syndrome. In another embodiment, a subject having a complement component C5-associated disease has myasthenia gravis. In yet another embodiment, a subject having a complement component C5-associated disease has neuromyelistis optica. In one embodiment, a subject having a complement component C5-associated disease has dense deposit disease. In one embodiment, a subject having a complement component C5-associated disease has C3 neuropathy. In another embodiment, a subject having a complement component C5-associated disease has age-related macular degeneration. In another embodiment, a subject having a complement component C5-associated disease has cold agglutinin disease. In one embodiment, a subject having a complement component C5-associated disease has anti-neutrophil cytoplasmic antibody-associated vasculitis. In another embodiment, a subject having a complement component C5-associated disease has humoral and vascular transplant rejection. In one embodiment, a subject having a complement component C5-associated disease has graft dysfunction. In one embodiment, a subject having a complement component C5-associated disease has had a myocardial infarction. In another embodiment, a subject having a complement component C5-associated disease is a sensitized recipient of a transplant. In yet another embodiment, a subject having a complement component C5-associated disease has sepsis.

Treatment of a subject that would benefit from a reduction and/or inhibition of C5 gene expression includes therapeutic and prophylactic (e.g., the subject is to undergo sensitized (or allogenic) transplant surgery) treatment.

The invention further provides methods and uses of an iRNA agent or a pharmaceutical composition thereof (including methods and uses of an iRNA agent or a pharmaceutical composition comprising an iRNA agent and an anti-complement component C5 antibody, or antigen-binding fragment thereof) for treating a subject that would benefit from reduction and/or inhibition of C5 expression, e.g., a subject having a complement component C5-associated disease, in combination with other pharmaceuticals and/or other therapeutic methods, e.g., with known pharmaceuticals and/or known therapeutic methods, such as, for example, those which are currently employed for treating these disorders. For example, in certain embodiments, an iRNA targeting C5 is administered in combination with, e.g., an agent useful in treating a complement component C5-associated disease as described elsewhere herein.

For example, additional therapeutics and therapeutic methods suitable for treating a subject that would benefit from reduction in C5 expression, e.g., a subject having a complement component C5-associated disease, include plasmaphoresis, thrombolytic therapy (e.g., streptokinase), anti-platelet agents; folic acid, corticosteroids; immunosuppressive agents; estrogens, methotrexate, 6-MP, azathioprine sulphasalazine, mesalazine, olsalazine, chloroquinine/hydroxychloroquine, pencillamine, aurothiomalate (intramuscular and oral), azathioprine, cochicine, corticosteroids (oral, inhaled and local injection), beta-2 adrenoreceptor agonists (salbutamol, terbutaline, salmeteral), xanthines (theophylline, aminophylline), cromoglycate, nedocromil, ketotifen, ipratropium and oxitropium, cyclosporin, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signalling by proinflammatory cytokines, such as TNF-α or IL-1 (e.g., IRAK, NIK, IKK, p38 or MAP kinase inhibitors), IL-1β (converting enzyme inhibitors, TNFα converting enzyme (TACE) inhibitors, T-cell signalling inhibitors, such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors and the derivatives p75TNFRIgG (Enbrel™ and p55TNFRIgG (Lenercept)), sIL-1RI, sIL-1RII, and sIL-6R), antiinflammatory cytokines (e.g., IL-4, IL-10, IL-11, IL-13 and TGFβ), celecoxib, folic acid, hydroxychloroquine sulfate, rofecoxib, etanercept, infliximonoclonal antibody, naproxen, valdecoxib, sulfasalazine, methylprednisolone, meloxicam, methylprednisolone acetate, gold sodium thiomalate, aspirin, triamcinolone acetonide, propoxyphene napsylate/apap, folate, nabumetone, diclofenac, piroxicam, etodolac, diclofenac sodium, oxaprozin, oxycodone hcl, hydrocodone bitartrate/apap, diclofenac sodium/misoprostol, fentanyl, anakinra, human recombinant, tramadol hcl, salsalate, sulindac, cyanocobalamin/fa/pyridoxine, acetaminophen, alendronate sodium, prednisolone, morphine sulfate, lidocaine hydrochloride, indomethacin, glucosamine sulf/chondroitin, amitriptyline hcl, sulfadiazine, oxycodone hcl/acetaminophen, olopatadine hcl, misoprostol, naproxen sodium, omeprazole, cyclophosphamide, rituximonoclonal antibody, IL-1 TRAP, MRA, CTLA4-IG, IL-18 BP, anti-IL-18, Anti-IL15, BIRB-796, SCIO-469, VX-702, AMG-548, VX-740, Roflumilast, IC-485, CDC-801, Mesopram, cyclosporine, cytokine suppressive anti-inflammatory drug(s) (CSAIDs); CDP-571/BAY-10-3356 (humanized anti-TNFα antibody; Celltech/Bayer); cA2/infliximonoclonal antibody (chimeric anti-TNFα antibody; Centocor); 75 kdTNFR-IgG/etanercept (75 kD TNF receptor-IgG fusion protein; Immunex; see e.g., (1994) Arthr. Rheum. 37: S295; (1996) J. Invest. Med. 44: 235A); 55 kdTNF-IgG (55 kD TNF receptor-IgG fusion protein; Hoffmann-LaRoche); IDEC-CE9.1/SB 210396 (non-depleting primatized anti-CD4 antibody; IDEC/SmithKline; see e.g., (1995) Arthr. Rheum. 38: S185); DAB 486-IL-2 and/or DAB 389-IL-2 (IL-2 fusion proteins; Seragen; see e.g., (1993) Arthrit. Rheum. 36: 1223); Anti-Tac (humanized anti-IL-2RcL; Protein Design Labs/Roche); IL-4 (anti-inflammatory cytokine; DNAX/Schering); IL-10 (SCH 52000; recombinant IL-10, anti-inflammatory cytokine; DNAX/Schering); IL-4; IL-10 and/or IL-4 agonists (e.g., agonist antibodies); IL-RA (IL-1 receptor antagonist; Synergen/Amgen); anakinra (Kineret®/Amgen); TNF-bp/s-TNF (soluble TNF binding protein; see e.g., (1996) Arthr. Rheum. 39(9 (supplement)): S284; (1995) Amer. J. Physiol.—Heart and Circ. Physiol. 268: 37-42); R973401 (phosphodiesterase Type IV inhibitor; see e.g., (1996) Arthr. Rheum. 39(9 (supplement): S282); MK-966 (COX-2 Inhibitor; see e.g., (1996) Arthr. Rheum. 39(9 (supplement): S81); Iloprost (see e.g., (1996) Arthr. Rheum. 39(9 (supplement): S82); methotrexate; thalidomide (see e.g., (1996) Arthr. Rheum. 39(9 (supplement): S282) and thalidomide-related drugs (e.g., Celgen); leflunomide (anti-inflammatory and cytokine inhibitor; see e.g., (1996) Arthr. Rheum. 39(9 (supplement): S131; (1996) Inflamm. Res. 45: 103-107); tranexamic acid (inhibitor of plasminogen activation; see e.g., (1996) Arthr. Rheum. 39(9 (supplement): S284); T-614 (cytokine inhibitor; see e.g., (1996) Arthr. Rheum. 39(9 (supplement): S282); prostaglandin E1 (see e.g., (1996) Arthr. Rheum. 39(9 (supplement): S282); Tenidap (non-steroidal anti-inflammatory drug; see e.g., (1996) Arthr. Rheum. 39(9 (supplement): S280); Naproxen (non-steroidal anti-inflammatory drug; see e.g., (1996) Neuro. Report 7: 1209-1213); Meloxicam (non-steroidal anti-inflammatory drug); Ibuprofen (non-steroidal anti-inflammatory drug); Piroxicam (non-steroidal anti-inflammatory drug); Diclofenac (non-steroidal anti-inflammatory drug); Indomethacin (non-steroidal anti-inflammatory drug); Sulfasalazine (see e.g., (1996) Arthr. Rheum. 39(9 (supplement): S281); Azathioprine (see e.g., (1996) Arthr. Rheum. 39(9 (supplement): S281); ICE inhibitor (inhibitor of the enzyme interleukin-1β converting enzyme); zap-70 and/or lck inhibitor (inhibitor of the tyrosine kinase zap-70 or lck); VEGF inhibitor and/or VEGF-R inhibitor (inhibitors of vascular endothelial cell growth factor or vascular endothelial cell growth factor receptor; inhibitors of angiogenesis); corticosteroid anti-inflammatory drugs (e.g., SB203580); TNF-convertase inhibitors; anti-IL-12 antibodies; anti-IL-18 antibodies; interleukin-11 (see e.g., (1996) Arthr. Rheum. 39(9 (supplement): S296); interleukin-13 (see e.g., (1996) Arthr. Rheum. 39(9 (supplement): S308); interleukin-17 inhibitors (see e.g., (1996) Arthr. Rheum. 39(9 (supplement): S120); gold; penicillamine; chloroquine; chlorambucil; hydroxychloroquine; cyclosporine; cyclophosphamide; total lymphoid irradiation; anti-thymocyte globulin; anti-CD4 antibodies; CD5-toxins; orally-administered peptides and collagen; lobenzarit disodium; Cytokine Regulating Agents (CRAs) HP228 and HP466 (Houghten Pharmaceuticals, Inc.); ICAM-1 antisense phosphorothioate oligo-deoxy-nucleotides (ISIS 2302; Isis Pharmaceuticals, Inc.); soluble complement receptor 1 (TP10; T Cell Sciences, Inc.); prednisone; orgotein; glycosaminoglycan polysulphate; minocycline; anti-IL2R antibodies; marine and botanical lipids (fish and plant seed fatty acids; see e.g., DeLuca et al. (1995) Rheum. Dis. Clin. North Am. 21: 759-777); auranofin; phenylbutazone; meclofenamic acid; flufenamic acid; intravenous immune globulin; zileuton; azaribine; mycophenolic acid (RS-61443); tacrolimus (FK-506); sirolimus (rapamycin); amiprilose (therafectin); cladribine (2-chlorodeoxyadenosine); methotrexate; bcl-2 inhibitors (see Bruncko, M. et al. (2007) J. Med. Chem. 50(4): 641-662); antivirals and immune-modulating agents, small molecule inhibitor of KDR, small molecule inhibitor of Tie-2; methotrexate; prednisone; celecoxib; folic acid; hydroxychloroquine sulfate; rofecoxib; etanercept; infliximonoclonal antibody; leflunomide; naproxen; valdecoxib; sulfasalazine; methylprednisolone; ibuprofen; meloxicam; methylprednisolone acetate; gold sodium thiomalate; aspirin; azathioprine; triamcinolone acetonide; propxyphene napsylate/apap; folate; nabumetone; diclofenac; piroxicam; etodolac; diclofenac sodium; oxaprozin; oxycodone hcl; hydrocodone bitartrate/apap; diclofenac sodium/misoprostol; fentanyl; anakinra, human recombinant; tramadol hcl; salsalate; sulindac; cyanocobalamin/fa/pyridoxine; acetaminophen; alendronate sodium; prednisolone; morphine sulfate; lidocaine hydrochloride; indomethacin; glucosamine sulfate/chondroitin; cyclosporine; amitriptyline hcl; sulfadiazine; oxycodone hcl/acetaminophen; olopatadine hcl; misoprostol; naproxen sodium; omeprazole; mycophenolate mofetil; cyclophosphamide; rituximonoclonal antibody; IL-1 TRAP; MRA; CTLA4-IG; IL-18 BP; IL-12/23; anti-IL 18; anti-IL 15; BIRB-796; SCIO-469; VX-702; AMG-548; VX-740; Roflumilast; IC-485; CDC-801; mesopram, albuterol, salmeterol/fluticasone, montelukast sodium, fluticasone propionate, budesonide, prednisone, salmeterol xinafoate, levalbuterol hcl, albuterol sulfate/ipratropium, prednisolone sodium phosphate, triamcinolone acetonide, beclomethasone dipropionate, ipratropium bromide, azithromycin, pirbuterol acetate, prednisolone, theophylline anhydrous, methylprednisolone sodium succinate, clarithromycin, zafirlukast, formoterol fumarate, influenza virus vaccine, methylprednisolone, amoxicillin trihydrate, flunisolide, allergy injection, cromolyn sodium, fexofenadine hydrochloride, flunisolide/menthol, amoxicillin/clavulanate, levofloxacin, inhaler assist device, guaifenesin, dexamethasone sodium phosphate, moxifloxacin hcl, doxycycline hyclate, guaifenesin/d-methorphan, p-ephedrine/cod/chlorphenir, gatifloxacin, cetirizine hydrochloride, mometasone furoate, salmeterol xinafoate, benzonatate, cephalexin, pe/hydrocodone/chlorphenir, cetirizine hcl/pseudoephed, phenylephrine/cod/promethazine, codeine/promethazine, cefprozil, dexamethasone, guaifenesin/pseudoephedrine, chlorpheniramine/hydrocodone, nedocromil sodium, terbutaline sulfate, epinephrine, methylprednisolone, metaproterenol sulfate, aspirin, nitroglycerin, metoprolol tartrate, enoxaparin sodium, heparin sodium, clopidogrel bisulfate, carvedilol, atenolol, morphine sulfate, metoprolol succinate, warfarin sodium, lisinopril, isosorbide mononitrate, digoxin, furosemide, simvastatin, ramipril, tenecteplase, enalapril maleate, torsemide, retavase, losartan potassium, quinapril hcl/mag carb, bumetanide, alteplase, enalaprilat, amiodarone hydrochloride, tirofiban hcl m-hydrate, diltiazem hydrochloride, captopril, irbesartan, valsartan, propranolol hydrochloride, fosinopril sodium, lidocaine hydrochloride, eptifibatide, cefazolin sodium, atropine sulfate, aminocaproic acid, spironolactone, interferon, sotalol hydrochloride, potassium chloride, docusate sodium, dobutamine hcl, alprazolam, pravastatin sodium, atorvastatin calcium, midazolam hydrochloride, meperidine hydrochloride, isosorbide dinitrate, epinephrine, dopamine hydrochloride, bivalirudin, rosuvastatin, ezetimibe/simvastatin, avasimibe, and cariporide.

The iRNA agent (and/or an anti-complement component C5 antibody) and an additional therapeutic agent and/or treatment may be administered at the same time and/or in the same combination, e.g., parenterally, or the additional therapeutic agent can be administered as part of a separate composition or at separate times and/or by another method known in the art or described herein.

The present invention also provides methods of using an iRNA agent of the invention and/or a composition containing an iRNA agent of the invention to reduce and/or inhibit complement component C5 expression in a cell. In other aspects, the present invention provides an iRNA of the invention and/or a composition comprising an iRNA of the invention for use in reducing and/or inhibiting C5 expression in a cell. In yet other aspects, use of an iRNA of the invention and/or a composition comprising an iRNA of the invention for the manufacture of a medicament for reducing and/or inhibiting C5 expression in a cell are provided.

The methods and uses include contacting the cell with an iRNA, e.g., a dsRNA, of the invention and maintaining the cell for a time sufficient to obtain degradation of the mRNA transcript of a C5 gene, thereby inhibiting expression of the C5 gene in the cell.

Reduction in gene expression can be assessed by any methods known in the art. For example, a reduction in the expression of C5 may be determined by determining the mRNA expression level of C5 using methods routine to one of ordinary skill in the art, e.g., Northern blotting, qRT-PCR, by determining the protein level of C5 using methods routine to one of ordinary skill in the art, such as Western blotting, immunological techniques, flow cytometry methods, ELISA, and/or by determining a biological activity of C5, such as $CH_{50}$ or $AH_{50}$ hemolysis assay, and/or by determining the biological activity of one or more molecules associated with the complement system, e.g., C5 products, such as C5a and C5b (or, in an in vivo setting, e.g., hemolysis).

In the methods and uses of the invention the cell may be contacted in vitro or in vivo, i.e., the cell may be within a subject. In embodiments of the invention in which the cell is within a subject, the methods may include further contacting the cell with an anti-complement component C5 antibody, e.g., eculizumab.

A cell suitable for treatment using the methods of the invention may be any cell that expresses a C5 gene. A cell suitable for use in the methods and uses of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell, e.g., a human liver cell.

C5 expression may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 85%, 86%, 87%, 88%, 89%, 90%, 91%, 92%, 93%, 94%, 95%, 96%, 97%, 98%, 99%, or about 100%.

The in vivo methods and uses of the invention may include administering to a subject a composition containing an iRNA, where the iRNA includes a nucleotide sequence that is complementary to at least a part of an RNA transcript of the C5 gene of the mammal to be treated. When the organism to be treated is a mammal such as a human, the composition can be administered by any means known in the art including, but not limited to subcutaneous, intravenous, oral, intraperitoneal, or parenteral routes, including intracranial (e.g., intraventricular, intraparenchymal and intrathecal), intramuscular, transdermal, airway (aerosol), nasal, rectal, and topical (including buccal and sublingual) administration. In certain embodiments, the compositions are administered by subcutaneous or intravenous infusion or injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of C5, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of a C5 gene in a mammal, e.g., a human. The present invention also provides a composition comprising an iRNA, e.g., a dsRNA, that targets a C5 gene in a cell of a mammal for use in inhibiting expression of the C5 gene in the mammal. In another aspect, the present invention provides use of an iRNA, e.g., a dsRNA, that targets a C5 gene in a cell of a mammal in the manufacture of a medicament for inhibiting expression of the C5 gene in the mammal.

The methods and uses include administering to the mammal, e.g., a human, a composition comprising an iRNA, e.g., a dsRNA, that targets a C5 gene in a cell of the mammal and maintaining the mammal for a time sufficient to obtain degradation of the mRNA transcript of the C5 gene, thereby inhibiting expression of the C5 gene in the mammal. In some embodiment, the methods further comprise administering an anti-complement component C5 antibody, e.g., eculizumab, to the subject.

Reduction in gene expression can be assessed by any methods known it the art and by methods, e.g. qRT-PCR, described herein. Reduction in protein production can be assessed by any methods known it the art and by methods, e.g., ELISA or Western blotting, described herein. In one embodiment, a puncture liver biopsy sample serves as the tissue material for monitoring the reduction in C5 gene and/or protein expression. In another embodiment, a blood sample serves as the tissue material for monitoring the reduction in C5 gene and/or protein expression. In other embodiments, inhibition of the expression of a C5 gene is monitored indirectly by, for example, determining the expression and/or activity of a gene in a C5 pathway, including, for example, C5a, C5b, and soluble C5b-9 (see, e.g., FIG. 1). For example, the activity of CD59 may be monitored to determine the inhibition of expression of a C5 gene. $CH_{50}$, $AH_{50}$, clot formation and/or serum lactate dehydrogenase (LDH), in a sample, e.g., a blood or liver sample, may also be measured. Suitable assays are further described in the Examples section below.

Unless otherwise defined, all technical and scientific terms used herein have the same meaning as commonly understood by one of ordinary skill in the art to which this invention belongs. Although methods and materials similar or equivalent to those described herein can be used in the practice or testing of the iRNAs and methods featured in the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1 iRNA Synthesis

Source of Reagents

Where the source of a reagent is not specifically given herein, such reagent can be obtained from any supplier of reagents for molecular biology at a quality/purity standard for application in molecular biology.

Transcripts siRNA design was carried out to identify siRNAs targeting human, rhesus (*Macaca mulatta*), mouse, and rat C5 transcripts annotated in the NCBI Gene database (http://www.ncbi.nlm.nih.gov/gene/). Design used the following transcripts from the NCBI RefSeq collection: Human—NM_001735.2; Rhesus—XM_001095750.2; Mouse—NM_010406.2; Rat—XM_345342.4. SiRNA duplexes were designed in several separate batches, including but not limited to batches containing duplexes matching human and rhesus transcripts only; human, rhesus, and mouse transcripts only; human, rhesus, mouse, and rat transcripts only; and mouse and rat transcripts only. All siRNA duplexes were designed that shared 100% identity with the listed human transcript and other species transcripts considered in each design batch (above).

siRNA Design, Specificity, and Efficacy Prediction

The predicted specificity of all possible 19mers was predicted from each sequence. Candidate 19mers were then selected that lacked repeats longer than 7 nucleotides. These 2971 candidate human/rhesus, 142 human/rhesus/mouse, 54 human/rhesus/mouse/rat, and 807 mouse/rat siRNAs were used in comprehensive searches against the appropriate transcriptomes (defined as the set of NM_ and XM_records within the human, rhesus, dog, mouse, or rat NCBI Refseq sets) using an exhaustive "brute-force" algorithm implemented in the python script BruteForce.py. The script next parsed the transcript-oligo alignments to generate a score based on the position and number of mismatches between the siRNA and any potential off-target transcript. The off-target score is weighted to emphasize differences in the 'seed' region of siRNAs, in positions 2-9 from the 5'-end of the molecule.

Each oligo-transcript pair from the brute-force search was given a mismatch score by summing the individual mismatch scores; mismatches in the position 2-9 were counted as 2.8, mismatches in the cleavage site positions 10-11 were counted as 1.2, and mismatches in region 12-19 counted as 1.0. An additional off-target prediction was carried out by comparing the frequency of heptamers and octomers derived from 3 distinct, seed-derived hexamers of each oligo. The hexamers from positions 2-7 relative to the 5' start were used to create 2 heptamers and one octomer. 'Heptamer1' was created by adding a 3'-A to the hexamer; heptamer2 was created by adding a 5'-A to the hexamer; the octomer was created by adding an A to both 5'- and 3'-ends of the hexamer. The frequency of octamers and heptamers in the human, rhesus, mouse, or rat 3'-UTRome (defined as the subsequence of the transcriptome from NCBI's Refseq database where the end of the coding region, the 'CDS', is clearly defined) was pre-calculated. The octamer frequency was normalized to the heptamer frequency using the median value from the range of octamer frequencies. A 'mirSeedScore' was then calculated by calculating the sum of ((3× normalized octamer count)+ (2× heptamer2 count)+(1× heptamer1 count)).

Both siRNAs strands were assigned to a category of specificity according to the calculated scores: a score above 3 qualifies as highly specific, equal to 3 as specific and between 2.2 and 2.8 as moderately specific. The duplexes were sorted by the specificity of the antisense strand and those duplexes whose antisense oligos lacked GC at the first position, lacked G at both positions 13 and 14, and had 3 or more Us or As in the seed region were selected.

For GalNaC-conjugated duplexes, sense 21mer and antisense 23mer oligos were designed by extending antisense 19mers (described above) to 23 nucleotides of target-complementary sequence. All species transcripts included in the design batch were checked for complementarity. Only 23mers that preserved 100% sequence complementarity in at least 2 species were used. For each duplex, the sense 21mer was specified as the reverse complement of the first 21 nucleotides of the antisense strand.

siRNA Sequence Selection

A total of 23 sense and 23 antisense derived human/rhesus, 6 sense and 6 antisense human/rhesus/mouse, 6 sense and 6 antisense derived human/rhesus/mouse/mouse/rat, and 13 sense and 13 antisense derived mouse/rat siRNA 19mer oligos were synthesized and formed into duplexes.

The above 19mer sets were extended to 21/23mer duplexes for GalNac conjugate design and re-classified according to their new species matches. Twenty-seven sense and 27 antisense derived human/rhesus, 1 sense and 1 sense derived human/rhesus/mouse, 3 sense and 3 antisense derived human/rhesus/rat, 4 sense and 4 antisense derived human/rhesus/mouse/rat, and 13 sense and 13 antisense derived mouse/rat 21mer (sense) and 23mer (antisense) oligos were synthesized and formed into duplexes.

A detailed list of C5 sense and antisense strand sequences is shown in Tables 3-6.

siRNA Synthesis

General Small and Medium Scale RNA Synthesis Procedure

RNA oligonucleotides were synthesized at scales between 0.2-500 µmol using commercially available 5'-O-(4,4'-dimethoxytrityl)-2'-O-t-butyldimethylsilyl-3'-O-(2-cyanoethyl-N,N-diisopropyl)phosphoramidite monomers of uridine, 4-N-acetylcytidine, 6-N-benzoyladenosine and 2-N-isobutyrylguanosine and the corresponding 2'-O-methyl and 2'-fluoro phosphoramidites according to standard solid phase oligonucleotide synthesis protocols. The amidite solutions were prepared at 0.1-0.15 M concentration and 5-ethylthio-1H-tetrazole (0.25-0.6 M in acetonitrile) was used as the activator. Phosphorothioate backbone modifications were introduced during synthesis using 0.2 M phenylacetyl disulfide (PADS) in lutidine:acetonitrile (1:1) (v;v) or 0.1 M 3-(dimethylaminomethylene) amino-3H-1,2,4-dithiazole-5-thione (DDTT) in pyridine for the oxidation step. After completion of synthesis, the sequences were cleaved from the solid support and deprotected using methylamine followed by triethylamine.3HF to remove any 2'-O-t-butyldimethylsilyl protecting groups present.

For synthesis scales between 5-500 µmol and fully 2' modified sequences (2'-fluoro and/or 2'-O-methyl or combinations thereof) the oligonucleotides where deprotected using 3:1 (v/v) ethanol and concentrated (28-32%) aqueous ammonia either at 35° C. 16 h or 55° C. for 5.5 h. Prior to ammonia deprotection the oligonucleotides where treated with 0.5 M piperidine in acetonitrile for 20 min on the solid support. The crude oligonucleotides were analyzed by LC-MS and anion-exchange HPLC (IEX-HPLC). Purification of the oligonucleotides was carried out by IEX HPLC using: 20 mM phosphate, 10%-15% ACN, pH=8.5 (buffer A) and 20 mM phosphate, 10%-15% ACN, 1 M NaBr, pH=8.5 (buffer B). Fractions were analyzed for purity by analytical HPLC. The product-containing fractions with suitable purity were pooled and concentrated on a rotary evaporator prior to desalting. The samples were desalted by size exclusion chromatography and lyophilized to dryness. Equal molar amounts of sense and antisense strands were annealed in 1×PBS buffer to prepare the corresponding siRNA duplexes.

For small scales (0.2-1 µmol), synthesis was performed on a MerMade 192 synthesizer in a 96 well format. In case of fully 2'-modified sequences (2'-fluoro and/or 2'-O-methyl or combinations thereof) the oligonucleotides where deprotected using methylamine at room temperature for 30-60 min followed by incubation at 60° C. for 30 min or using 3:1 (v/v) ethanol and concentrated (28-32%) aqueous ammonia at room temperature for 30-60 min followed by incubation at 40° C. for 1.5 hours. The crude oligonucleotides were then precipitated in a solution of acetonitrile:acetone (9:1) and isolated by centrifugation and decanting the supernatant. The crude oligonucleotide pellet was re-suspended in 20 mM NaOAc buffer and analyzed by LC-MS and anion exchange HPLC. The crude oligonucleotide sequences were desalted in 96 deep well plates on a 5 mL HiTrap Sephadex G25 column (GE Healthcare). In each well about 1.5 mL samples corresponding to an individual sequence was collected. These purified desalted oligonucleotides were analyzed by LC-MS and anion exchange chromatography. Duplexes were prepared by annealing equimolar amounts of sense and antisense sequences on a Tecan robot. Concentration of duplexes was adjusted to 10 µM in 1×PBS buffer.

Synthesis of GalNAc-Conjugated Oligonucleotides for In Vivo Analysis

Oligonucleotides conjugated with GalNAc ligand at their 3'-terminus were synthesized at scales between 0.2-500 µmol using a solid support pre-loaded with a Y-shaped linker bearing a 4,4'-dimethoxytrityl (DMT)-protected primary hydroxy group for oligonucleotide synthesis and a GalNAc ligand attached through a tether.

For synthesis of GalNAc conjugates in the scales between 5-500 µmol, the above synthesis protocol for RNA was followed with the following adaptions: For polystyrene-based synthesis supports 5% dichloroacetic acid in toluene was used for DMT-cleavage during synthesis. Cleavage from the support and deprotection was performed as described above. Phosphorothioate-rich sequences (usually >5 phorphorothioates) were synthesized without removing the final 5'-DMT group ("DMT-on") and, after cleavage and deprotection as described above, purified by reverse phase HPLC using 50 mM ammonium acetate in water (buffer A) and 50 mM ammoniumacetate in 80% acetonitirile (buffer B). Fractions were analyzed for purity by analytical HPLC and/or LC-MS. The product-containing fractions with suitable purity were pooled and concentrated on a rotary evaporator. The DMT-group was removed using 20%-25% acetic acid in water until completion. The samples were desalted by size exclusion chromatography and lyophilized to dryness. Equal molar amounts of sense and antisense strands were annealed in 1×PBS buffer to prepare the corresponding siRNA duplexes.

For small scale synthesis of GalNAc conjugates (0.2-1 µmol), including sequences with multiple phosphorothioate linkages, the protocols described above for synthesis of RNA or fully 2'-F/2'-OMe-containing sequences on MerMade platform were applied. Synthesis was performed on pre-packed columns containing GalNAc-functionalized controlled pore glass support.

Example 2

In Vitro Screening

Cell Culture and Transfections

Hep3B cells (ATCC, Manassas, Va.) were grown to near confluence at 37° C. in an atmosphere of 5% CO2 in Eagle's Minimum Essential Medium (ATCC) supplemented with 10% FBS, streptomycin, and glutamine (ATCC) before being released from the plate by trypsinization. Cells were washed and re-suspended at $0.25 \times 10^6$ cells/ml. During transfections, cells were plated onto a 96-well plate with about 20,000 cells per well.

Primary mouse hepatocytes (PMH) were freshly isolated from a C57BL/6 female mouse (Charles River Labortories International, Inc. Willmington, Mass.) less than 1 hour prior to transfections and grown in primary hepatocyte media. Cells were resuspended at $0.11 \times 10^6$ cells/ml in InVitroGRO CP Rat (plating) medium (Celsis In Vitro Technologies, catalog number S01494). During transfections, cells were plated onto a BD BioCoat 96 well collagen plate (BD, 356407) at 10,000 cells per well and incubated at 37° C. in an atmosphere of 5% $CO_2$.

Cryopreserved Primary Cynomolgus Hepatocytes (Celsis In Vitro Technologies, M003055-P) were thawed at 37° C. water bath immediately prior to usage and re-suspended at $0.26 \times 10^6$ cells/ml in InVitroGRO CP (plating) medium (Celsis In Vitro Technologies, catalog number Z99029). During transfections, cells were plated onto a BD BioCoat 96 well collagen plate (BD, 356407) at 25,000 cells per well and incubated at 37° C. in an atmosphere of 5% $CO_2$.

For Hep3B, PMH, and primary Cynomolgus hepatocytes, transfection was carried out by adding 14.8 µl of Opti-MEM plus 0.2 µl of Lipofectamine RNAiMax per well (Invitrogen, Carlsbad Calif. catalog number13778-150) to 5 µl of each siRNA duplex to an individual well in a 96-well plate. The mixture was then incubated at room temperature for 20 minutes. Eighty µl of complete growth media without antibiotic containing the appropriate cell number were then added to the siRNA mixture. Cells were incubated for 24 hours prior to RNA purification.

Single dose experiments were performed at 10 nM and 0.1 nM final duplex concentration for GalNAc modified sequences or at 1 nM and 0.01 nM final duplex concentration for all other sequences. Dose response experiments were done at 3, 1, 0.3, 0.1, 0.037, 0.0123, 0.00412, and 0.00137 nM final duplex concentration for primary mouse hepatocytes and at 3, 1, 0.3, 0.1, 0.037, 0.0123, 0.00412, 0.00137, 0.00046, 0.00015, 0.00005, and 0.000017 nM final duplex concentration for Hep3B cells.

Free Uptake Transfection

Free uptake experiments were performed by adding 10 µl of siRNA duplexes in PBS per well into a 96 well plate. Ninety µl of complete growth media containing appropriate cell number for the cell type was then added to the siRNA. Cells were incubated for 24 hours prior to RNA purification. Single dose experiments were performed at 500 nM and 5 nM final duplex concentration and dose response experiments were done at 1000, 333, 111, 37, 12.3, 4.12, 1.37, 0.46 nM final duplex concentration.

Total RNA Isolation Using DYNABEADS mRNA Isolation Kit (Invitrogen, Part #: 610-12)

Cells were harvested and lysed in 150 µl of Lysis/Binding Buffer then mixed for 5 minutes at 850 rpm using an Eppendorf Thermomixer (the mixing speed was the same throughout the process). Ten microliters of magnetic beads and 80 µl Lysis/Binding Buffer mixture were added to a round bottom plate and mixed for 1 minute. Magnetic beads were captured using a magnetic stand and the supernatant was removed without disturbing the beads. After removing the supernatant, the lysed cells were added to the remaining beads and mixed for 5 minutes. After removing the supernatant, magnetic beads were washed 2 times with 150 µl Wash Buffer A and mixed for 1 minute. The beads were capturedagain and the supernatant was removed. The beads were then washed with 150 µl Wash Buffer B, captured and the supernatant was removed. The beads were next washed with 150 µl Elution Buffer, captured and the supernatant removed. Finally, the beads were allowed to dry for 2 minutes. After drying, 50 µl of Elution Buffer was added and mixed for 5 minutes at 70° C. The beads were captured on magnet for 5 minutes. Forty-five µl of supernatant was removed and added to another 96 well plate.

cDNA Synthesis Using ABI High Capacity cDNA Reverse Transcription Kit (Applied Biosystems, Foster City, Calif., Cat #4368813)

A master mix of 2 µl 10× Buffer, 0.8 µl 25×dNTPs, 2 µl Random primers, 1 µl Reverse Transcriptase, 1 µl RNase inhibitor and 3.2 µl of H2O per reaction as prepared. Equal volumes master mix and RNA were mixed for a final volume of 12 µl for in vitro screened or 20 µl for in vivo screened samples. cDNA was generated using a Bio-Rad C-1000 or S-1000 thermal cycler (Hercules, Calif.) through the following steps: 25° C. for 10 minutes, 37° C. for 120 minutes, 85° C. for 5 seconds, and 4° C. hold.

Real Time PCR

Two µl of cDNA were added to a master mix containing 2 µl of $H_2O$, 0.51 µl GAPDH TaqMan Probe (Life Technologies catalog number 4326317E for Hep3B cells, catalog number 352339E for primary mouse hepatocytes or custom probe for cynomolgus primary hepatocytes), 0.5 µl C5 TaqMan probe (Life Technologies c catalog number Hs00156197_m1 for Hep3B cells or mm00439275_m1 for Primary Mouse Hepatoctyes or custom probe for cynomolgus primary hepatocytes) and 5 µl Lightcycler 480 probe master mix (Roche catalog number 04887301001) per well in a 384 well plates (Roche catalog number 04887301001). Real time PCR was performed in an Roche LC480 Real Time PCR system (Roche) using the ΔΔCt(RQ) assay. For in vitro screening, each duplex was tested with two biological replicates unless otherwise noted and each Real Time PCR was performed in duplicate technical replicates. For in vivo screening, each duplex was tested in one or more experiments (3 mice per group) and each Real Time PCR was run in duplicate technical replicates.

To calculate relative fold change in C5 mRNA levels, real time data were analyzed using the ΔΔCt method and normalized to assays performed with cells transfected with 10 nM AD-1955, or mock transfected cells. $IC_{50}$s were calculated using a 4 parameter fit model using XLFit and normalized to cells transfected with AD-1955 over the same dose range, or to its own lowest dose.

The sense and antisense sequences of AD-1955 are:

SENSE:
(SEQ ID NO: 13)
cuuAcGcuGAGuAcuucGAdTsdT;

ANTISENSE:
(SEQ ID NO: 14)
UCGAAGuACUcAGCGuAAGdTsdT.

Table 7 shows the results of a single dose screen in Hep3B cells transfected with the indicated GalNAC conjugated modified iRNAs. Data are expressed as percent of message remaining relative to untreated cells.

Table 8 shows the results of a single dose transfection screen in primary mouse hepatocytes transfected with the indicated GalNAC conjugated modified iRNAs. Data are expressed as percent of message remaining relative to untreated cells.

Table 9 shows the results of a single dose free uptake screen in primary *Cynomolgus* hepatocytes with the indicated GalNAC conjugated modified iRNAs. Data are expressed as percent of message remaining relative to untreated cells.

Table 10 shows the results of a single dose free uptake screen in primary mouse hepatocytes with the indicated GalNAC conjugated modified iRNAs. Data are expressed as percent of message remaining relative to untreated cells.

Table 11 shows the dose response of a free uptake screen in primary *Cynomolgus* hepatocytes with the indicated GalNAC conjugated modified iRNAs. The indicated $IC_{50}$ values represent the $IC_{50}$ values relative to untreated cells.

Table 12 shows the dose response of a free uptake screen in primary mouse hepatocytes with the indicated GalNAC conjugated modified iRNAs. The indicated $IC_{50}$ values represent the $IC_{50}$ values relative to untreated cells.

Table 13 shows the results of a single dose screen in Hep3B cells transfected with the indicated modified and unmodified iRNAs. Data are expressed as percent of message remaining relative to untreated cells. The 0.01 nM dose was a single biological transfection and the 1 nM dose was a duplicate biological transfection.

Table 14 shows the results of a single dose screen in primary mouse hepatocytes transfected with the indicated modified and unmodified iRNAs. Data are expressed as percent of message remaining relative to untreated cells.

Table 15 shows the dose response in Hep3B cells transfected with the indicated modified and unmodified iRNAs. The indicated $IC_{50}$ values represent the $IC_{50}$ values relative to untreated cells.

Table 16 shows the dose response in primary mouse hepatocytes transfected with the indicated modified and unmodified iRNAs. The indicated $IC_{50}$ values represent the $IC_{50}$ values relative to untreated cells.

TABLE 2

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |
| (dt) | deoxy-thymine |

TABLE 3

Unmodified Sense and Antisense Strand Sequences of C5 dsRNAs

| Duplex ID | Sense strand | Sense Unmodified Sequence | SEQ ID NO: | Antisense | Antisense Unmodified Sequence | SEQ ID NO: | Species_Oligo name[1] |
|---|---|---|---|---|---|---|---|
| AD-58093.1[2] UM[3] | A-118310.1 | AAUAACUCAUAUAAUUACUU | 15 | A-118311.1 | AAGUAAUUAUAGUGAGUUAUUUU | 66 | NM_001735.2_1517-1539_as |
| AD-58099.1 UM | A-118312.1 | UGACAAAAUAACUCACUAUAA | 16 | A-118313.1 | UUAUAGUGAGUUAUUUUGUCAAU | 67 | NM_001735.2_1511-1533_as |
| AD-58105.1 UM | A-118314.1 | CUUCCUCUGGAAAUUGGCCUU | 17 | A-118315.1 | AAGGCCAAUUUCCAGAGGAAGCA | 68 | NM_001735.2_2733-2755_as |
| AD-58111.1 UM | A-118316.1 | GACAAAAUAACUCACUAUAAU | 18 | A-118317.1 | AUUAUAGUGAGUUAUUUUGUCAA | 69 | NM_001735.2_1512-1534_as |
| AD-58117.1 UM | A-118318.1 | UCCUCUGGAAAUGGCCUUCA | 19 | A-118319.1 | UGAAGGCCAAUUUCCAGAGGAAG | 70 | NM_001735.2_2735-2757_as |
| AD-58123.1 UM | A-118320.1 | AAGCAAGAUAUUUUAUAUA | 20 | A-118321.1 | UAUAUAAAAAUAUCUUGCUUUU | 71 | NM_001735.2_784-806_as |
| AD-58129.1 UM | A-118322.1 | AAAAGUUUUGUCAGUACA | 21 | A-118323.1 | UGUACUUGACAAAAACAUUUUCU | 72 | NM_001735.2_4744-4766_as |
| AD-58088.1 UM | A-118324.1 | AUUUAAACAACAAGUACCUUU | 22 | A-118325.1 | AAAGGUACUUGUUGUUUAAAUCU | 73 | NM_001735.2_982-1004_as |
| AD-58094.1 UM | A-118326.1 | AUUCAGAAAGUCUGUGAAGGA | 23 | A-118327.1 | UCCUUCACAGACUUUCUGAAUUU | 74 | NM_001735.2_4578-4600_as |
| AD-58100.1 UM | A-118328.1 | ACACUGAAGCAUUUGAUGCAA | 24 | A-118329.1 | UUGCAUCAAAUGCUUCAGUGUAU | 75 | NM_001735.2_169-191_as |
| AD-58106.1 UM | A-118330.1 | GCAGUCUGUGUUAAAAUGUC | 25 | A-118331.1 | GACAUUUUAACACAGAACUGCAU | 76 | NM_001735.2_2591-2613_as |
| AD-58112.1 UM | A-118332.1 | AGGAUUUUGAGUGUAAAGGA | 26 | A-118333.1 | UCCUUUACACUCAAAAAUCCUUU | 77 | NM_001735.2_2955-2977_as |
| AD-58118.1 UM | A-118334.1 | AAUGAUGAACCUUGUAAAGAA | 27 | A-118335.1 | UUCUUUACAAGGUUCAUCAUUUU | 78 | NM_001735.2_2025-2047_as |
| AD-58124.1 UM | A-118336.1 | AUCAUUGGAACAUUUUUCAU | 28 | A-118337.1 | AAUGAAAAAUGUUCCAAUGAUUU | 79 | NM_001735.2_3118-3140_as |
| AD-58130.1 UM | A-118338.1 | AGCCAGAAAUUCGGAGUUAUU | 29 | A-118339.1 | AAUAACUCCGAAUUUCUGGCUUG | 80 | NM_001735.2_2317-2339_as |
| AD-58089.1 UM | A-118340.1 | UCCCUGGGAGAUAAAACUCAC | 30 | A-118341.1 | GUGAGUUUUAUCUCCCAGGGAAA | 81 | NM_001735.2_3618-3640_as |
| AD-58095.1 UM | A-118342.1 | GAAAAUGAUGAACCUUGUAAA | 31 | A-118343.1 | UUUACAAGGUUCAUCAUUUUCUU | 82 | NM_001735.2_2022-2044_as |
| AD-58101.1 UM | A-118344.1 | AUUGCUCAAGUCACAUUUGAU | 32 | A-118345.1 | AUCAAAUGUGACUUGAGCAAUUC | 83 | NM_001735.2_918-940_as |
| AD-58107.1 UM | A-118346.1 | GAGAUUGCAUAUGCUUUAUAAA | 33 | A-118347.1 | UUUAUAAGCAUAUGCAAUCUCUG | 84 | NM_001735.2_4698-4720_as |

TABLE 3-continued

Unmodified Sense and Antisense Strand Sequences of C5 dsRNAs

| Duplex ID | Sense strand | Sense Unmodified sequence | SEQ ID NO: | Antisense | Antisense Unmodified Sequence | SEQ ID NO: | Species_Oligo name[1] |
|---|---|---|---|---|---|---|---|
| AD-58113.1 UM | A-118348.1 | GUUAUCCUGAUAAAAAUUUA | 34 | A-118349.1 | UAAAUUUUUAUCAGGAUAACUU | 85 | NM_001735.2_205-227_as |
| AD-58119.1 UM | A-118350.1 | AGGAGUUUGCAGCUUUUAUU | 35 | A-118351.1 | AAUAAAAGCUGCAAACUUCCUCA | 86 | NM_001735.2_4147-4169_as |
| AD-58125.1 UM | A-118352.1 | GAAGAAAUGAUCAUAUUGGA | 36 | A-118353.1 | UCCAAUAUGAUCAUUUCUUCUA | 87 | NM_001735.2_555-577_as |
| AD-58131.1 UM | A-118354.1 | AUCCUGAUAAAAAUUUAGUU | 37 | A-118355.1 | AACUAAAUUUUUAUCAGGAUAA | 88 | NM_001735.2_208-230_as |
| AD-58090.1 UM | A-118356.1 | UGGAAAGAAAUCUUAGUAAA | 38 | A-118357.1 | UUUACUAAGAUUUCUUUCCAAA | 89 | NM_001735.2_2786-2808_as |
| AD-58096.1 UM | A-118358.1 | UCUAUCAAAGUAUAAAACAUU | 39 | A-118359.1 | AAUGUUUUAUACUUUGAUAAGAUG | 90 | NM_001735.2_1596-1618_as |
| AD-58102.1 UM | A-118360.1 | UCCCUACAAACUGAAUUUGGU | 40 | A-118361.1 | ACCAAAUUCAGUUGUAGGGAGA | 91 | NM_001735.2_1082-1104_as |
| AD-58108.1 UM | A-118362.1 | CAGGAGCAAACAUAUGUCAUU | 41 | A-118363.1 | AAUGACAUAUGUUGCUCCUGUC | 92 | NM_001735.2_87-109_as |
| AD-58114.1 UM | A-118364.1 | ACAUGUAACAACUGUAGUUCA | 42 | A-118365.1 | UGAACUACAGUUGUUACAUGUAC | 93 | NM_001735.2_4109-4131_as |
| AD-58120.1 UM | A-118366.1 | CAGGAAAUCAUUGGAACAUUU | 43 | A-118367.1 | AAAUGUUCCAAUGAUUUCCUGUU | 94 | NM_001735.2_3112-3134_as |
| AD-58126.1 UM | A-118368.1 | UUUAAGAAUUUUGAAAUUACU | 44 | A-118369.1 | AGUAAUUCAAAAUUCUUAAAGU | 95 | NM_001735.2_759-781_as |
| AD-58132.1 UM | A-118370.1 | UAUUCUGCAACUGAAUUCGAU | 45 | A-118371.1 | AUCGAAUUCAGUUGCAGAAUAAC | 96 | NM_001735.2_4412-4434_as |
| AD-58091.1 UM | A-118372.1 | GCCCUUGGAAAGAGUAUUUCA | 46 | A-118373.1 | UGAAAUACUCUUUCCAAGGGCUU | 97 | NM_001735.2_1886-1908_as |
| AD-58097.1 UM | A-118374.1 | CCUGAUAAAAAAUUUAGUAC | 47 | A-118375.1 | GUAACUAAAUUUUUAUCAGGAU | 98 | NM_001735.2_210-232_as |
| AD-58103.1 UM | A-118376.1 | CCCUUGGAAAGAGUAUUUCAA | 48 | A-118377.1 | UUGAAAUACUCUUUCCAAGGGCU | 99 | NM_001735.2_1887-1909_as |
| AD-58121.1 UM | A-118382.1 | UGCAGAUCAAACACAAUUUCA | 49 | A-118383.1 | UGAAAUUGUGUUUUGAUCUGCAGA | 100 | NM_010406.2_4943-4965_as |
| AD-58133.1 UM | A-118386.1 | CAGAUCAAACACAAUUUCAGU | 50 | A-118387.1 | ACUGAAAUUGUGUUUGAUCUGCA | 101 | NM_010406.2_4945-4967_as |
| AD-58116.1 UM | A-118396.1 | GUUCCGGAUAUUUGAACUUUU | 51 | A-118397.1 | AAAAGUUCAAAUAUCCGGAACCG | 102 | NM_010406.2_4500-4522_as |

TABLE 3-continued

Unmodified Sense and Antisense Strand Sequences of C5 dsRNAs

| Duplex ID | Sense strand | Sense Unmodified sequence | SEQ ID NO: | Antisense | Antisense Unmodified Sequence | SEQ ID NO: | Species_Oligo name[1] |
|---|---|---|---|---|---|---|---|
| AD-58644.1 UM | A-119328.1 | AUUUAAACAACAAGUACCUUU | 52 | A-119329.1 | AAAGUACUUGUUGUUUAAAUCU | 103 | NM_001735.2_982-1004_as |
| AD-58651.1 UM | A-119328.2 | AUUUAAACAACAAGUACCUUU | 53 | A-119339.1 | AAAGUACUUGUUGUUUAAAUCU | 104 | NM_001735.2_982-1004_as |
| AD-58641.1 UM | A-119322.1 | UGACAAAAUAACUCACUAUAA | 54 | A-119323.1 | UUAUAGUGAGUUAUUUUGUCAAU | 105 | NM_001735.2_1511-1533_as |
| AD-58648.1 UM | A-119322.2 | UGACAAAAUAACUCACUAUAA | 55 | A-119336.1 | UUAUAGUGAGUUAUUUUGUCAAU | 106 | NM_001735.2_1511-1533_as |
| AD-58642.1 UM | A-119324.1 | GACAAAAUAACUCACUAUAAU | 56 | A-119325.1 | AUUAUAGUGAGUUAUUUUGUCAA | 107 | NM_001735.2_1512-1534_as |
| AD-58649.1 UM | A-119324.2 | GACAAAAUAACUCACUAUAAU | 57 | A-119337.1 | AUUAUAGUGAGUUAUUUUGUCAA | 108 | NM_001735.2_1512-1534_as |
| AD-58647.1 UM | A-119334.1 | GUUCCGGAUAUUUGAACUUUU | 58 | A-119335.1 | AAAAGUUCAAAUAUCCGGAACCG | 109 | NM_010406.2_4500-4522_as |
| AD-58654.1 UM | A-119334.2 | GUUCCGGAUAUUUGAACUUUU | 59 | A-119342.1 | AAAAGUUCAAAUAUCCGGAACCG | 110 | NM_010406.2_4500-4522_as |
| AD-58645.1 UM | A-119330.1 | UGCAGAUCAAACACAAUUUCA | 60 | A-119331.1 | UGAAAUUGUGUUUGAUCUGCAGA | 111 | NM_010406.2_4943-4965_as |
| AD-58652.1 UM | A-119330.2 | UGCAGAUCAAACACAAUUUCA | 61 | A-119340.1 | UGAAAUUGUGUUUGAUCUGCAGA | 112 | NM_010406.2_4943-4965_as |
| AD-58643.1 UM | A-119326.1 | AAGCAAGAUAUUUUUAUAAUA | 62 | A-119327.1 | UAUUAUAAAAAUAUCUUGCUUUU | 113 | NM_001735.2_784-806_as |
| AD-58650.1 UM | A-119326.2 | AAGCAAGAUAUUUUUAUAAUA | 63 | A-119338.1 | UAUUAUAAAAAUAUCUUGCUUUU | 114 | NM_001735.2_784-806_as |
| AD-58646.1 UM | A-119332.1 | CAGAUCAAACACAAUUUCAGU | 64 | A-119333.1 | ACUGAAAUUGUGUUUGAUCUGCA | 115 | NM_010406.2_4945-4967_as |
| AD-58653.1 UM | A-119332.2 | CAGAUCAAACACAAUUUCAGU | 65 | A-119341.1 | ACUGAAAUUGUGUUUGAUCUGCA | 116 | NM_010406.2_4945-4967_as |

[1]The Species_Oligo name reflects the GenBank record (e.g., NM_001735.2) and the position in the nucleotide sequence of the GenBank record (e.g., 1517-1539) that the antisense strand targets.
[2]The number following the decimal point refers to the lot number.
[3]UM = unmodified

TABLE 4

GalNAC Conjugated Modified Sense and Antisense Strand Sequences of C5 dsRNAs

| Duplex ID | Sense strand | Sense sequence | SEQ ID NO: Antisense | Antisense sequence | SEQ ID NO: name[4] Species_Oligo |
|---|---|---|---|---|---|
| AD-58093.1 | A-118310.1 | AfaUfaAfcUfcAfCfUfaUfaAfuUfaCfuUfL96 | 117A-118311.1 | aAfgUfaAfuUfaUfaguGfaGfuUfaUfusUfsu | 168 |
| AD-58099.1 | A-118312.1 | UfgAfcAfaAfauUfaAfcUfcAfcUfaUfaAfL96 | 118A-118313.1 | uUfaUfaGfuGfaGfuuaUfuUfuGfuCfasAfsu | 169 |
| AD-58105.1 | A-118314.1 | CfuUfcCfuCfuGfGfaAfaUfuUfggGfcCfuUfL96 | 119A-118315.1 | aAfgGfcCfaAfuUfuccAfgAfgGfaAfgsCfsa | 170 |
| AD-58111.1 | A-118316.1 | GfaCfaAfaAfuAfCfucCfaCfuAfuAfuAfuUfL96 | 120A-118317.1 | aUfuAfuAfgUfgAfguuAfuUfuUfgUfcsAfsa | 171 |
| AD-58117.1 | A-118318.1 | UfcCfuCfuGfgAfaAfuUfggGfcCfuUfcAfuUfL96 | 121A-118319.1 | uGfaAfgGfcCfaAfuuuCfcAfgAfgGfasAfsg | 172 |
| AD-58123.1 | A-118320.1 | AfaGfcAfgGfaUfaUfuUfuUfaUfaAfuAfuUfL96 | 122A-118321.1 | uAfuUfaUfaAfaAfauaUfcUfuGfcUfusUfsu | 173 |
| AD-58129.1 | A-118322.1 | AfaAfaUfgUfuUfUfuUfgUfCfaAfaGfuAfcAfL96 | 123A-118323.1 | uGfuAfcUfuGfaCfaaaAfaCfaUfuUfusCfsu | 174 |
| AD-58088.1 | A-118324.1 | AfuUfaAfaAfcAfAfCfaAfguGfuCfaCfcUfuUfL96 | 124A-118325.1 | aAfaGfgUfaCfuUfguuGfuUfuAfaAfusCfsu | 175 |
| AD-58094.1 | A-118326.1 | AfcAfcAfgAfaGfCfAfuUfgGfuGfuAfaGfaAfL96 | 125A-118327.1 | uCfcUfucCfaCfaGfacuUfuCfuGfaAfusUfsu | 176 |
| AD-58100.1 | A-118328.1 | GfcAfgUfcCfuGfuFfGfuGfuAfaAfaAfuGfuCfL96 | 126A-118329.1 | uUfgCfaUfcAfaAfugcUfuCfaGfuGfcsAfsu | 177 |
| AD-58106.1 | A-118330.1 | GfaUfgAfuUfuGfaAfaAfaAfaAfuGfaAfuCfL96 | 127A-118331.1 | gAfcAfuUfuUfaAfcacAfgAfaCfuGfcsAfsu | 178 |
| AD-58112.1 | A-118332.1 | AfgGfaUfuUfuGfaAfGfuAfaAfaAfgGfaAfL96 | 128A-118333.1 | uCfcUfuUfuUfaAfcAfcucAfaAfaUfcCfusUfsu | 179 |
| AD-58118.1 | A-118334.1 | AfaUfgAfuGfaAfcCfcUfuUfcAfaUfaGfaAfL96 | 129A-118335.1 | uUfcUfuUfaCfaAfgguUfcAfuCfaUfusUfsu | 180 |
| AD-58124.1 | A-118336.1 | AfuCfaUfuGfgAfCfaAfcUfuUfcGfaAfuUfL96 | 130A-118337.1 | aAfuUfgAfaAfaAfuUfguCfcAfaUfgAfusUfsu | 181 |
| AD-58130.1 | A-118338.1 | AfgCfcAfgAfaAfuFfcGfaAfuAfaAfuAfuUfL96 | 131A-118339.1 | aAfuAfaCfuCfcGfaauUfcUfgGfcUfusUfsg | 182 |
| AD-58089.1 | A-118340.1 | UfcCfuGfgGfgAfGfaAfuAfaAfaCfuCfaCfuUfL96 | 132A-118341.1 | gUfgAfgUfuUfuAfucuCfcCfaGfgGfasAfsa | 183 |
| AD-58095.1 | A-118342.1 | GfaAfaAfuGfaUfGfaAfaCfcUfuGfuAfaAfL96 | 133A-118343.1 | uUfuAfcAfaGfgUfucaUfcAfuUfuUfcsUfsu | 184 |
| AD-58101.1 | A-118344.1 | AfuUfgCfuCfaAfGfuCfAfcAfuUfuGfaUfL96 | 134A-118345.1 | aUfcAfaAfuGfuGfacuUfgAfgCfaAfusUfsc | 185 |
| AD-58107.1 | A-118346.1 | GfaGfaUfuGfcAfAfGfuCfuFfuAfaFfaAfL96 | 135A-118347.1 | uUfuAfuAfaGfcAfuauGfcAfuFfcsUfsg | 186 |

TABLE 4-continued

GalNAC Conujugated Modified Sense and Antisense Strand Sequences of C5 dsRNAs

| Duplex ID | Sense strand | Sense sequence | SEQ ID NO:Antisense | Antisense sequence | SEQ ID NO:name[4] Species_Oligo |
|---|---|---|---|---|---|
| AD-58113.1 | A-118348.1 | GfuUfaUfcCfuGfAfUfaAfaAfaAfuUfuAfL96 | 136A-118349.1 | uAfaAfuUfuUfaucAfgGfaAfcsUfsu | 187 |
| AD-58119.1 | A-118350.1 | AfgGfaAfgUfuUfgCfaGfcUfuUfuAfuUfL96 | 137A-118351.1 | aAfuAfaAfaGfcUfgcaAfaCfuUfcCfusCfsa | 188 |
| AD-58125.1 | A-118352.1 | GfaAfgAfaAfuUfgAfuCfaUfaUfuGfgAfL96 | 138A-118353.1 | uCfcAfaUfaUfgAfucaAfuUfcUfcsUfsa | 189 |
| AD-58131.1 | A-118354.1 | AfuCfcUfgAfuAfaAfaAfuCfuUfaGfuUfL96 | 139A-118355.1 | aAfcUfaAfaUfuUfuuuAfuCfaGfgAfusAfsa | 190 |
| AD-58090.1 | A-118356.1 | UfgGfaAfaAfgAfaAfuCfuUfaGfuAfaAfL96 | 140A-118357.1 | uUfuAfcUfaAfgAfuuuCfuUfuCfcfasAfsa | 191 |
| AD-58096.1 | A-118358.1 | UfcUfUfaUfcUfaAfAfGfuAfuAfaAfcAfuUfL96 | 141A-118359.1 | aAfuGfuUfuAfuAfcuuUfgAfuAfgasUfsg | 192 |
| AD-58102.1 | A-118360.1 | UfcCfcUfaCfaAfcCfuGfaAfuUfuGfgUfL96 | 142A-118361.1 | aCfcAfaAfuUfcAfguuUfgUfaGfgGfasGfsa | 193 |
| AD-58108.1 | A-118362.1 | CfaGfaGfcUfaAfcfcfaUfaUfcCfaUfuUfL96 | 143A-118363.1 | aAfuGfaCfaUfaUfguuUfgCfuCfcfUfgsUfsc | 194 |
| AD-58114.1 | A-118364.1 | AfcAfuGfuAfcAfaCfaCfaAfcUfgUfuUfcAfL96 | 144A-118365.1 | uGfaAfcUfaCfaGfuugUfuAfcAfuGfusAfsc | 195 |
| AD-58120.1 | A-118366.1 | CfaGfaGfAfauCfuGfaAfaUfuUfaAfcUfL96 | 145A-118367.1 | aAfaUfgUfuCfcAfaugAfuUfuCfcUfcsUfsu | 196 |
| AD-58126.1 | A-118368.1 | UfuUfaAfgAfaUfUfuUfuGfaAfaAfuUfAfcUfL96 | 146A-118369.1 | aGfuaUfuUfcAfaaaUfuCfuUfaAfasGfsu | 197 |
| AD-58132.1 | A-118370.1 | UfaAfuCfuGfcAfAfcfuGfaAfuUfcGfaUfL96 | 147A-118371.1 | aUfcGfaAfuUfaCfuCfuuuCfcAfaGfGfcsAfsc | 198 |
| AD-58091.1 | A-118372.1 | GfcCfcUfgAfAfaAfaAfgfgfaAfuUfuCfAfL96 | 148A-118373.1 | uGfaAfcUfaCfuCfuuuUfuuUfuAfuCfaGfgsAfsu | 199 |
| AD-58097.1 | A-118374.1 | CfcCfuUfgGfaAfaAfaAfgUfuUfuAfgUfaCfAfL96 | 149A-118375.1 | gUfaAfcUfaAfaUfuuuUfuAfuCfaGfgsAfsu | 200 |
| AD-58103.1 | A-118376.1 | CfcCfuUfgGfaAfaAfgAfuAfuUfuCfaAfL96 | 150A-118377.1 | uUfgAfaAfuAfcUfcuuUfcCfaAfgGfgsCfsu | 201 |
| AD-58121.1 | A-118382.1 | UfgCfaGfaUfcAfAfaAfcAfcAfuUfcAfL96 | 151A-118383.1 | uGfaAfuGfuGfuuuGfaUfcUfgCfasGfsa | 202 |
| AD-58133.1 | A-118386.1 | CfaGfaUfcAfaAfcfAfcAfuUfcAfgUfL96 | 152A-118387.1 | aCfuGfaAfuGfuGfuUfuGfaUfCfgsCfsa | 203 |
| AD-58116.1 | A-118396.1 | GfuUfcCfgGfaUfAfuUfgaAfcfUfuUfL96 | 153A-118397.1 | aAfaAfgUfuCfAfauaUfcCfgGfaAfcsCfsg | 204 |

TABLE 4-continued

GalNAC Conujugated Modified Sense and Antisense Strand Sequences of C5 dsRNAs

| Duplex ID | Sense strand | Sense sequence | SEQ ID NO:Antisense | Antisense sequence | SEQ ID NO:name[4] Species_Oligo |
|---|---|---|---|---|---|
| AD-58644.1 | A-119328.1 | AfsusUfuAfaAfcAfAfcCfaAfgUfaCfcUfuUfL96 | 154A-119329.1 | asAfsaGfgUfaCfuUfguuGfuUfuAfaAfuscsu | 205 |
| AD-58651.1 | A-119328.2 | AfsusUfuAfaAfcAfAfcCfaAfgUfaCfcUfuUfL96 | 155A-119339.1 | asAfsaGfsgUfsaCfsuUfsguuGfsuUfsuAfsaAfsuscsu | 206 |
| AD-58641.1 | A-119322.1 | UfsggAfcAfaAfaUfAfAfcUfcAfcUfaAfaAfL96 | 156A-119323.1 | usUfsaUfaGfuGfaGfuuaUfuUfuGfuCfasasau | 207 |
| AD-58648.1 | A-119322.2 | UfsggAfcAfaAfaUfAfAfcUfcAfcUfaAfaAfL96 | 157A-119336.1 | usUfsaUfsaGfsuGfsaGfsuuaUfsuUfsuGfsuCfsasasasu | 208 |
| AD-58642.1 | A-119324.1 | GfsasCfaAfaAfuAfuAfAfcCfuCfacCfuAfuAfaAfL96 | 158A-119325.1 | asUfsuAfuAfgUfgAfguuAfuUfuUfgUfcsasa | 209 |
| AD-58649.1 | A-119324.2 | GfsasCfaAfaAfuAfuAfAfcCfuCfacCfuAfuAfaAfL96 | 159A-119337.1 | asUfsaUfsuAfsgUfsgAfsguuAfsuUfsuUfsgUfscsasa | 210 |
| AD-58647.1 | A-119334.1 | GfsusUfcCfgGfaUfUfuUfgAfaCfuUfuUfL96 | 160A-119335.1 | asAfsaAfgUfuCfaAfauaUfcCfgGfaAfcscsg | 211 |
| AD-58654.1 | A-119334.2 | GfsusUfcCfgGfaUfUfuUfgAfaCfuUfuUfL96 | 161A-119342.1 | asAfsaAfsgUfsuCfsaAfsauaUfscCfsgGfsaAfscscsg | 212 |
| AD-58645.1 | A-119330.1 | UfsggCfaGfaUfcAfAfAfcAfaUfuUfcAfLL96 | 162A-119331.1 | usGfsaAfsaUfaUfuGfuuuGfaUfcUfgCfasgsa | 213 |
| AD-58652.1 | A-119330.2 | UfsggCfaGfaUfcAfAfAfcAfaUfuUfcAfLL96 | 163A-119340.1 | usGfsaAfsaUfsaUfsuGfsuuuGfsaUfscUfsgCfsasgsa | 214 |
| AD-58643.1 | A-119326.1 | AfsaaGfcAfaGfaUfuUfuUfaUfaAfaAfLL96 | 164A-119327.1 | usAfsuUfaAfaAfauaUfcUfuGfcUfususu | 215 |
| AD-58650.1 | A-119326.2 | AfsaaGfcAfaGfaUfuUfuUfaUfaAfaAfLL96 | 165A-119338.1 | usAfsuUfsaUfsaAfsaAfsauaUfscUfsuGfscUfsususu | 216 |
| AD-58646.1 | A-119332.1 | CfsasGfaUfcAfaAfcCfAfcAfaUfuUfcAfgUfL96 | 166A-119333.1 | asCfsuGfaAfaUfuGfuguUfuGfaUfcUfgscsa | 217 |
| AD-58653.1 | A-119332.2 | CfsasGfaUfcAfaAfcCfAfcAfaUfuUfcAfgUfL96 | 167A-119341.1 | asCfsuGfsaAfsaUfsuGfsuguUfsuGfsaUfscUfsgscsa | 218 |

[4]The Species oligo name and the position in the nucleotide sequence of the GenBank record that the antisense strand targets correspond to those shown in Table 3.

TABLE 5

Unmodified Sense and Antisense Strand Sequences of C5 dsRNAs

| Duplex ID | Sense strand | Sense Unmodified Sequence | SEQ ID NO: | Antisense | Antisense Unmodified Sequence | SEQ ID NO: | Species_Oligo name |
|---|---|---|---|---|---|---|---|
| AD-58143.1 | UMA-118423.1 | CACUAUAAUUACUUGAUUU | 219 | A-118424.1 | AAAUCAAGUAAUUAUAGUG | 302 | NM_001735.2_1522-1540_as |
| AD-58149.1 | UMA-118425.1 | UAACUCACUAUAAUUACUU | 220 | A-118426.1 | AAGUAAUUAUAGUGAGUUA | 303 | NM_001735.2_1517-1535_as |
| AD-58155.1 | UMA-118427.1 | ACAAAAUAACUCACUAUAA | 221 | A-118428.1 | UUAUAGUGAGUUAUUUUGU | 304 | NM_001735.2_1511-1529_as |
| AD-58161.1 | UMA-118429.1 | UCCUCUGGAAAUGGCCCUU | 222 | A-118430.1 | AAGGCCAUUUCCAGAGGA | 305 | NM_001735.2_2733-2751_as |
| AD-58167.1 | UMA-118431.1 | CAAAAUAACUCACUAUAAU | 223 | A-118432.1 | AUUAUAGUGAGUUAUUUUG | 306 | NM_001735.2_1512-1530_as |
| AD-58173.1 | UMA-118433.1 | CUCUGGAAAUGGCCCUUCA | 224 | A-118434.1 | UGAAGGCCAUUUCCAGAG | 307 | NM_001735.2_2735-2753_as |
| AD-58179.1 | UMA-118435.1 | GCAAGAUAUUUUAUAUAUA | 225 | A-118436.1 | UAUUAUAUAAAAUAUCUGC | 308 | NM_001735.2_784-802_as |
| AD-58185.1 | UMA-118437.1 | AAUGUUUUGUCAAGUACA | 226 | A-118438.1 | UGUACUUGACAAAACAUU | 309 | NM_001735.2_4744-4762_as |
| AD-58144.1 | UMA-118439.1 | UUAAACAACAAGUACCUUU | 227 | A-118440.1 | AAAGGUACUUGUUGUUUAA | 310 | NM_001735.2_982-1000_as |
| AD-58150.1 | UMA-118441.1 | UCAGAAAGUCUGUGAAGGA | 228 | A-118442.1 | UCCUUCACAGACUUUCUGA | 311 | NM_001735.2_4578-4596_as |
| AD-58156.1 | UMA-118443.1 | ACUGAAGCAUUUGAUGCAA | 229 | A-118444.1 | UUGCAUCAAAUGCUUCAGU | 312 | NM_001735.2_169-187_as |
| AD-58162.1 | UMA-118445.1 | AGUUCUGUGUUAAAAUGUC | 230 | A-118446.1 | GACAUUUUAACACAGAACU | 313 | NM_001735.2_2591-2609_as |
| AD-58168.1 | UMA-118447.1 | GAUUUUGAGUGUAAAGGA | 231 | A-118448.1 | UCCUUUACACUCAAAAUC | 314 | NM_001735.2_2955-2973_as |
| AD-58174.1 | UMA-118449.1 | UGAUGAACCUGUAAAGAA | 232 | A-118450.1 | UUCUUUACAAGGUUCAUCA | 315 | NM_001735.2_2025-2043_as |
| AD-58180.1 | UMA-118451.1 | CAUUGGAACAUUUUUCAUU | 233 | A-118452.1 | AAUGAAAAAUGUUCCAAUG | 316 | NM_001735.2_3118-3136_as |
| AD-58186.1 | UMA-118453.1 | CCAGAAAUUCCGAGUAUU | 234 | A-118454.1 | AAUAACUCCGAAUUCUGG | 317 | NM_001735.2_2317-2335_as |
| AD-58145.1 | UMA-118455.1 | CCUGGGAGAUAAAAUCCAC | 235 | A-118456.1 | GUGAGUUUAUCUCCCAGG | 318 | NM_001735.2_3618-3636_as |
| AD-58151.1 | UMA-118457.1 | AAAUGAUGAACCUUGUAAA | 236 | A-118458.1 | UUUACAAGGUUCAUCAUUU | 319 | NM_001735.2_2022-2040_as |
| AD-58157.1 | UMA-118459.1 | UGCUCAAGUCACAUUUGAU | 237 | A-118460.1 | AUCAAAUGUGACUUGAGCA | 320 | NM_001735.2_918-936_as |
| AD-58163.1 | UMA-118461.1 | GAUUGCAUAUGCUUAUAAA | 238 | A-118462.1 | UUUAUAAGCAUAUGCAAUC | 321 | NM_001735.2_4698-4716_as |
| AD-58169.1 | UMA-118463.1 | UAUCCUGAUAAAAAUUUA | 239 | A-118464.1 | UAAAUUUUUAUCAGGAUA | 322 | NM_001735.2_205-223_as |
| AD-58175.1 | UMA-118465.1 | GAAGUUGCAGCUUUUAUU | 240 | A-118466.1 | AAUAAAAGCUGCAAACUUC | 323 | NM_001735.2_4147-4165_as |
| AD-58181.1 | UMA-118467.1 | AGAAAUUGAUCAUAUUGGA | 241 | A-118468.1 | UCCAAUAUGAUCAAUUUCU | 324 | NM_001735.2_555-573_as |
| AD-58187.1 | UMA-118469.1 | CCUGAUAAAAAUUUUAGUU | 242 | A-118470.1 | AACUAAAAUUUUUAUCAGG | 325 | NM_001735.2_208-226_as |

TABLE 5-continued

Unmodified Sense and Antisense Strand Sequences of C5 dsRNAs

| Duplex ID | Sense strand | Sense Unmodified Sequence | SEQ ID NO: | Antisense | Antisense Unmodified Sequence | SEQ ID NO: | Species_Oligo name |
|---|---|---|---|---|---|---|---|
| AD-58146.1 | UMA-118471.1 | GAAAAGAAAUCUUAGUAAA | 243 | A-118472.1 | UUUACUAAGAUUUCUUUUC | 326 | NM_001735.2_2786-2804_as |
| AD-58152.1 | UMA-118473.1 | UUAUCAAGAUAUAAACAUU | 244 | A-118474.1 | AAUGUUUAUACUUUGAUAA | 327 | NM_001735.2_1596-1614_as |
| AD-58158.1 | UMA-118475.1 | CCUACAAACUGAAUUGGU | 245 | A-118476.1 | ACCAAAUUCAGUUUGUAGG | 328 | NM_001735.2_1082-1100_as |
| AD-58164.1 | UMA-118477.1 | GGAGCAAACAUAUGUCAUU | 246 | A-118478.1 | AAUGACAUAUGUUUGCUCC | 329 | NM_001735.2_87-105_as |
| AD-58170.1 | UMA-118479.1 | AUGUAACAACUGUAGUCA | 247 | A-118480.1 | UGAACUACAGUUGUUACAU | 330 | NM_001735.2_4109-4127_as |
| AD-58176.1 | UMA-118481.1 | GGAAAUCAUUGGAACAUU | 248 | A-118482.1 | AAAUGUCCAAUGAUUUCC | 331 | NM_001735.2_3112-3130_as |
| AD-58182.1 | UMA-118483.1 | UAAGAAUUUGAAAUUACU | 249 | A-118484.1 | AGUAAUUUCAAAAUUCUUA | 332 | NM_001735.2_759-777_as |
| AD-58188.1 | UMA-118485.1 | UUCUGCAACUGAAUUCCAU | 250 | A-118486.1 | AUCGAAUUCAGUUGCAGAA | 333 | NM_001735.2_4412-4430_as |
| AD-58147.1 | UMA-118487.1 | CCUUGGAAAGAGUAUUUCA | 251 | A-118488.1 | UGAAAUACUCUUUCCAAGG | 334 | NM_001735.2_1886-1904_as |
| AD-58153.1 | UMA-118489.1 | UGAUAAAAAUUUUAGUAC | 252 | A-118490.1 | GUAACUAAAAUUUUUAUCA | 335 | NM_001735.2_210-228_as |
| AD-58159.1 | UMA-118491.1 | CUUGGAAAGAGUAUUUCAA | 253 | A-118492.1 | UUGAAAUACUCUUUCCAAG | 336 | NM_001735.2_1887-1905_as |
| AD-58190.1 | UMA-118519.1 | CACUAUAAUUACUUGAUUU | 254 | A-118520.1 | AAAUCAAGUAAUAUAGUG | 337 | NM_001735.2_1522-1540_as |
| AD-58196.1 | UMA-118521.1 | UAACUCACUAUAAUUACUU | 255 | A-118522.1 | AAGUAAUUAUAGUGAGUUA | 338 | NM_001735.2_1517-1535_as |
| AD-58202.1 | UMA-118523.1 | ACAAAAUAACUCACUAUAA | 256 | A-118524.1 | UUAUAGUGAGUUAUUUUGU | 339 | NM_001735.2_1511-1529_as |
| AD-58208.1 | UMA-118525.1 | UCCUCUGGAAAUUGGCCUU | 257 | A-118526.1 | AAGGCCAAUUUCCAGAGGA | 340 | NM_001735.2_2733-2751_as |
| AD-58214.1 | UMA-118527.1 | CAAAAUAACUCACUAUAAU | 258 | A-118528.1 | AUUAUAGUGAGUAUUUUG | 341 | NM_001735.2_1512-1530_as |
| AD-58220.1 | UMA-118529.1 | CUCUGGAAAAUUGGCCUUCA | 259 | A-118530.1 | UGAAGGCCAAUUUCCAGAG | 342 | NM_001735.2_2735-2753_as |
| AD-58226.1 | UMA-118531.1 | GCAAGAUAUUUUUAUAUA | 260 | A-118532.1 | UAUUAUAAAAAUAUCUUGC | 343 | NM_001735.2_784-802_as |
| AD-58231.1 | UMA-118533.1 | AAUGUUUUGUCAAGUACA | 261 | A-118534.1 | UGUACUUGACAAAACAUU | 344 | NM_001735.2_4744-4762_as |
| AD-58191.1 | UMA-118535.1 | UUAAAACAAGUACCUUU | 262 | A-118536.1 | AAAGGUACUUGUUUUAA | 345 | NM_001735.2_982-1000_as |
| AD-58197.1 | UMA-118537.1 | UCAGAAAGUCUGUGAAGGA | 263 | A-118538.1 | UCCUUCACAGACUUUCUGA | 346 | NM_001735.2_4578-4596_as |

TABLE 5-continued

Unmodified Sense and Antisense Strand Sequences of C5 dsRNAs

| Duplex ID | Sense strand | Sense Unmodified Sequence | SEQ ID NO: Antisense | Antisense | Antisense Unmodified Sequence | SEQ ID NO: | Species_Oligo name |
|---|---|---|---|---|---|---|---|
| AD-58203.1 | UMA-118539.1 | ACUGAAGCAUUUGAUGCAA | 264 | A-118540.1 | UUGCAUCAAAUGCUUCAGU | 347 | NM_001735.2_169-187_as |
| AD-58209.1 | UMA-118541.1 | AGUUCUGUGUUAAAAUGUC | 265 | A-118542.1 | GACAUUUUAACACAGAACU | 348 | NM_001735.2_2591-2609_as |
| AD-58233.1 | UMA-118565.1 | CACUAUAAUUACUUGAUUU | 266 | A-118566.1 | AAAUCAAGUAAUUAUAUGUG | 349 | NM_001735.2_1522-1540_as |
| AD-58193.1 | UMA-118567.1 | UAACUCACUAUAAUUACUU | 267 | A-118568.1 | AAGUAAUUAUAGUGAGUUA | 350 | NM_001735.2_1517-1535_as |
| AD-58199.1 | UMA-118569.1 | ACAAAAUAACUCACUAUAA | 268 | A-118570.1 | UUAUAGUGAGUUAUUUUGU | 351 | NM_001735.2_1511-1529_as |
| AD-58205.1 | UMA-118571.1 | UCCUCUGGAAAUUGGCCUU | 269 | A-118572.1 | AAGGCCAAUUUCCAGAGGA | 352 | NM_001735.2_2733-2751_as |
| AD-58211.1 | UMA-118573.1 | CAAAAUAACUCACUAUAAU | 270 | A-118574.1 | AUUAUAGUGAGUUAUUUUG | 353 | NM_001735.2_1512-1530_as |
| AD-58217.1 | UMA-118575.1 | CUCUGGAAAUUGGCCUUCA | 271 | A-118576.1 | UGAAGGCCAAUUUCCAGAG | 354 | NM_001735.2_2735-2753_as |
| AD-58223.1 | UMA-118577.1 | GCAAGAUAUUUUAUAUAUA | 272 | A-118578.1 | UAUUAUAAAAAAAUAUCUGC | 355 | NM_001735.2_784-802_as |
| AD-58229.1 | UMA-118579.1 | AAUGUUUUGUCAAGUACA | 273 | A-118580.1 | UGUACUUGACAAAACAUU | 356 | NM_001735.2_4744-4762_as |
| AD-58234.1 | UMA-118581.1 | UUAAACAACAAGUACCUUU | 274 | A-118582.1 | AAAGGUACUUGUUGUUUAA | 357 | NM_001735.2_982-1000_as |
| AD-58194.1 | UMA-118583.1 | UCAGAAAGUCUGUGAAGGA | 275 | A-118584.1 | UCCUUCACAGACUUUCUGA | 358 | NM_001735.2_4578-4596_as |
| AD-58200.1 | UMA-118585.1 | ACUGAAGCAUUUGAUGCAA | 276 | A-118586.1 | UUGCAUCAAAUGCUUCAGU | 359 | NM_001735.2_169-187_as |
| AD-58206.1 | UMA-118587.1 | AGUUCUGUGUUAAAAUGUC | 277 | A-118588.1 | GACAUUUUAACACAGAACU | 360 | NM_001735.2_2591-2609_as |
| AD-58236.1 | UMA-118423.2 | CACUAUAAUUACUUGAUUU | 278 | A-118644.1 | AAAUCAAGUAAUUAUAUGUG | 361 | NM_001735.2_1522-1540_as |
| AD-58242.1 | UMA-118425.2 | UAACUCACUAUAAUUACUU | 279 | A-118645.1 | AAGUAAUUAUAGUGAGUUA | 362 | NM_001735.2_1517-1535_as |
| AD-58248.1 | UMA-118427.2 | ACAAAAUAACUCACUAUAA | 280 | A-118646.1 | UUAUAGUGAGUUAUUUUGU | 363 | NM_001735.2_1511-1529_as |
| AD-58254.1 | UMA-118429.2 | UCCUCUGGAAAUUGGCCUU | 281 | A-118647.1 | AAGGCCAAUUUCCAGAGGA | 364 | NM_001735.2_2733-2751_as |
| AD-58260.1 | UMA-118431.2 | CAAAAUAACUCACUAUAAU | 282 | A-118648.1 | AUUAUAGUGAGUUAUUUUG | 365 | NM_001735.2_1512-1530_as |
| AD-58266.1 | UMA-118433.2 | CUCUGGAAAUUGGCCUUCA | 283 | A-118649.1 | UGAAGGCCAAUUUCCAGAG | 366 | NM_001735.2_2735-2753_as |

TABLE 5-continued

Unmodified Sense and Antisense Strand Sequences of C5 dsRNAs

| Duplex ID | Sense strand | Sense Unmodified Sequence | SEQ ID NO: Antisense | Antisense | Antisense Unmodified Sequence | SEQ ID NO: | Species_Oligo name |
|---|---|---|---|---|---|---|---|
| AD-58272.1 | UMA-118435.2 | GCAAGAUAUUUUAUAUA | 284 | A-118650.1 | UAUUAUAAAAUAUCUUGC | 367 | NM_001735.2_784-802_as |
| AD-58277.1 | UMA-118437.2 | AAUGUUUUGUCAAGUACA | 285 | A-118651.1 | UGUACUUGACAAAACAUU | 368 | NM_001735.2_4744-4762_as |
| AD-58237.1 | UMA-118439.2 | UUAAACAACAAGUACCUUU | 286 | A-118652.1 | AAAGGUACUUGUUGUUUAA | 369 | NM_001735.2_982-1000_as |
| AD-58243.1 | UMA-118441.2 | UCAGAAGUCUGUGAAGGA | 287 | A-118653.1 | UCCUUCACAGACUUUCUGA | 370 | NM_001735.2_4578-4596_as |
| AD-58249.1 | UMA-118443.2 | ACUGAAGCAUUUGAUGCAA | 288 | A-118654.1 | UUGCAUCAAAUGCUUCAGU | 371 | NM_001735.2_169-187_as |
| AD-58255.1 | UMA-118445.2 | AGUUCUGUGUUAAAAUGUC | 289 | A-118655.1 | GACAUUUUAACACAGAACU | 372 | NM_001735.2_2591-2609_as |
| AD-58279.1 | UMA-118423.3 | CACUAUAAUUACUUGAUUU | 290 | A-118667.1 | AAAUCAAGUAAUUAUAGUG | 373 | NM_001735.2_1522-1540_as |
| AD-58239.1 | UMA-118425.3 | UAACUCACUAUAAUUACUU | 291 | A-118668.1 | AAGUAAUUAUAGUGAGUUA | 374 | NM_001735.2_1517-1535_as |
| AD-58245.1 | UMA-118427.3 | ACAAAAUAACUCACUAUAA | 292 | A-118669.1 | UUAUAGUGAGUUAUUUUGU | 375 | NM_001735.2_1511-1529_as |
| AD-58251.1 | UMA-118429.3 | UCCUCUGGAAAUGGCCUU | 293 | A-118670.1 | AAGGCCAAUUUCCAGAGGA | 376 | NM_001735.2_2733-2751_as |
| AD-58257.1 | UMA-118431.3 | CAAAAUAACUCACUAUAAU | 294 | A-118671.1 | AUUAUAGUGAGUUAUUUUG | 377 | NM_001735.2_1512-1530_as |
| AD-58263.1 | UMA-118433.3 | CUCUGGAAAUGGCCUUCA | 295 | A-118672.1 | UGAAGGCCAUUUCCAGAG | 378 | NM_001735.2_2735-2753_as |
| AD-58269.1 | UMA-118435.3 | GCAAGAUAUUUUAUAUA | 296 | A-118673.1 | UAUUAUAAAAUAUCUUGC | 379 | NM_001735.2_784-802_as |
| AD-58275.1 | UMA-118437.3 | AAUGUUUUGUCAAGUACA | 297 | A-118674.1 | UGUACUUGACAAAACAUU | 380 | NM_001735.2_4744-4762_as |
| AD-58280.1 | UMA-118439.3 | UUAAACAACAAGUACCUUU | 298 | A-118675.1 | AAAGGUACUUGUUGUUUAA | 381 | NM_001735.2_982-1000_as |
| AD-58240.1 | UMA-118441.3 | UCAGAAGUCUGUGAAGGA | 299 | A-118676.1 | UCCUUCACAGACUUUCUGA | 382 | NM_001735.2_4578-4596_as |
| AD-58246.1 | UMA-118443.3 | ACUGAAGCAUUUGAUGCAA | 300 | A-118677.1 | UUGCAUCAAAUGCUUCAGU | 383 | NM_001735.2_169-187_as |
| AD-58252.1 | UMA-118445.3 | AGUUCUGUGUUAAAAUGUC | 301 | A-118678.1 | GACAUUUUAACACAGAACU | 384 | NM_001735.2_2591-2609_as |

TABLE 6

Modified Sense and Antisense Strand Sequences of C5 dsRNAs

| Duplex ID | Sense strand | SEQ ID NO: Sense sequence | Antisense | SEQ ID NO: Antisense sequence | SEQ ID NO: Species_Oligo name[5] |
|---|---|---|---|---|---|
| AD-58143.1 | A-118423.1 | 385 cAcuAuAuuAcuuGAuuudTsdT | A-118424.1 | 468 AAAUcAAGuAAUuAuAGUGdTsdT | |
| AD-58149.1 | A-118425.1 | 386 uAAcuAcuAuAuuAcuudTsdT | A-118426.1 | 469 AAGuAAUuAuAGUGAGUuAdTsdT | |
| AD-58155.1 | A-118427.1 | 387 AcAAAAuAAcucAcuAuAAdTsdT | A-118428.1 | 470 UuAuAGuGAGUuAUUUUGUdTsdT | |
| AD-58161.1 | A-118429.1 | 388 ucccucuGGAAAuuGGccuudTsdT | A-118430.1 | 471 AAGGCcAAUUUCcAGAGGAdTsdT | |
| AD-58167.1 | A-118431.1 | 389 cAAAAuAcucAcuAuAAudTsdT | A-118432.1 | 472 AUuAuAGuGAGUuAUUUUGdTsdT | |
| AD-58173.1 | A-118433.1 | 390 cucuGGAAAuuGGccuucAdTsdT | A-118434.1 | 473 UGAAGGCcAAUUUCcAGAGdTsdT | |
| AD-58179.1 | A-118435.1 | 391 GcAAGAuAuuuuuAuAAdTsdT | A-118436.1 | 474 uAUuAuAAAAAuAUCUUGCdTsdT | |
| AD-58185.1 | A-118437.1 | 392 AAuGuuuuuGucAAGuAcAAdTsdT | A-118438.1 | 475 UGuACUUGACAAAAACAUUdTsdT | |
| AD-58144.1 | A-118439.1 | 393 uuAAAcAAcAAGuAccuuudTsdT | A-118440.1 | 476 AAAGGuACUUGUUGUUuAAdTsdT | |
| AD-58150.1 | A-118441.1 | 394 ucAGAAAGucuGuGAAGGAdTsdT | A-118442.1 | 477 UCCUUcAcAGACUUUCUGAdTsdT | |
| AD-58156.1 | A-118443.1 | 395 AcuGAAGcAuuuGAuGcAAdTsdT | A-118444.1 | 478 UUGcAUcAAAUGCUUcAGUdTsdT | |
| AD-58162.1 | A-118445.1 | 396 AGuucuGuGuuAAAAuGucdTsdT | A-118446.1 | 479 GAcAUUUuAAcAcAGAACUdTsdT | |
| AD-58168.1 | A-118447.1 | 397 GAuuuuGAGuGuAAAGGAdTsdT | A-118448.1 | 480 UCCUUUuAcACUcAAAAUCdTsdT | |
| AD-58174.1 | A-118449.1 | 398 uGAuGAAccuuGuAAGAAAdTsdT | A-118450.1 | 481 UUCUUuAcAGGGUUcAUcAdTsdT | |
| AD-58180.1 | A-118451.1 | 399 cAuuGGAAcAuuuuucAuudTsdT | A-118452.1 | 482 AAUGAAAAAUGUUCcAAUGdTsdT | |
| AD-58186.1 | A-118453.1 | 400 ccAGAAAuccGGAGuuAuudTsdT | A-118454.1 | 483 AAuAACUCCGAAUUUCUGGdTsdT | |
| AD-58145.1 | A-118455.1 | 401 ccuGGGAGAuAAAAcucAcdTsdT | A-118456.1 | 484 GUGAGUUuAUCUCCcAGGdTsdT | |
| AD-58151.1 | A-118457.1 | 402 AAAuGAuGAAccuuGuAAAAdTsdT | A-118458.1 | 485 UUuAcAAGGUUcAUcAUUUdTsdT | |
| AD-58157.1 | A-118459.1 | 403 uGcucAAGucAcAuuuuGAudTsdT | A-118460.1 | 486 AUcAAAAUGUGACUUGAGcAdTsdT | |
| AD-58163.1 | A-118461.1 | 404 GAuuGcAuAuGcuuAuAAAdTsdT | A-118462.1 | 487 UUuAuAAGcAuAUGcAAUCdTsdT | |

TABLE 6-continued

Modified Sense and Antisense Strand Sequences of C5 dsRNAs

| Duplex ID | Sense strand | Sense sequence | SEQ ID NO: Antisense | Antisense | Antisense sequence | SEQ ID NO: Species_Oligo name[5] |
|---|---|---|---|---|---|---|
| AD-58169.1 | A-118463.1 | uAuccuGAuAAAAAuuuAdTsdT | 405 | A-118464.1 | uAAAUUUUuAUcAGGAuAdTsdT | 488 |
| AD-58175.1 | A-118465.1 | GAAGuuuGcAGcuuuuAuudTsdT | 406 | A-118466.1 | AAuAAAAGCUGcAAACUCdTsdT | 489 |
| AD-58181.1 | A-118467.1 | AGAAAuuGAucAuAuuGGAdTsdT | 407 | A-118468.1 | UCcAAuAUGAUcAAUUUCUdTsdT | 490 |
| AD-58187.1 | A-118469.1 | ccuGaAuAAAAAuuuAGhudTsdT | 408 | A-118470.1 | AACuAAAUUUUuAUcAGGdTsdT | 491 |
| AD-58146.1 | A-118471.1 | GAAAAGAAAucuuAGuAAAdTsdT | 409 | A-118472.1 | UUuACuAAGAUUUCUUUUCdTsdT | 492 |
| AD-58152.1 | A-118473.1 | uuAucAAAGuAuAuAAACAuudTsdT | 410 | A-118474.1 | AAUGUUuAuACUUUGAuAAdTsdT | 493 |
| AD-58158.1 | A-118475.1 | ccuACAAAcuGAAuuuGGudTsdT | 411 | A-118476.1 | ACcAAAUUcAGUUUGuAGGdTsdT | 494 |
| AD-58164.1 | A-118477.1 | GGAGcAAAcAuAuGucAuudTsdT | 412 | A-118478.1 | AAUGAcAuAUGUUUGCUCCdTsdT | 495 |
| AD-58170.1 | A-118479.1 | AuGuAAcAAcuGAcuGUucAdTsdT | 413 | A-118480.1 | UGAACuAcAGUUGUuAcAUdTsdT | 496 |
| AD-58176.1 | A-118481.1 | GGAAucAuuGGAACAuuudTsdT | 414 | A-118482.1 | AAAUGUUccAAUGAUUCCdTsdT | 497 |
| AD-58182.1 | A-118483.1 | uAAGAAuuuuGAAAuAcudTsdT | 415 | A-118484.1 | AGuAAUUUcAAAAUUCUuAdTsdT | 498 |
| AD-58188.1 | A-118485.1 | uucuGcAAcuGAAuucGAudTsdT | 416 | A-118486.1 | AUCGAAUUcAGUUGcAGAAdTsdT | 499 |
| AD-58147.1 | A-118487.1 | ccuuGGAAAGAGAuuucAdTsdT | 417 | A-118488.1 | UGAAAuACUCUUUCcAAGGdTsdT | 500 |
| AD-58153.1 | A-118489.1 | uGAuAAAAAuuuAGuAcdTsdT | 418 | A-118490.1 | GuAACuAAAUUUUuAUcAdTsdT | 501 |
| AD-58159.1 | A-118491.1 | cuuGGAAAGAGuAuuucAdTsdT | 419 | A-118492.1 | UUGAAAuACUCUUUCcAAGdTsdT | 502 |
| AD-58190.1 | A-118519.1 | CACUAuAAUUACUGAUUUdTsdT | 420 | A-118520.1 | AAAUCAAGUAAUUAUAGUGdTdT | 503 |
| AD-58196.1 | A-118521.1 | UAACUCACUAUAAUUACUGdTdT | 421 | A-118522.1 | AAGUAAUUAUAGUGAGUUAdTdT | 504 |
| AD-58202.1 | A-118523.1 | ACAAAAUAACUCACUAUAAdTdT | 422 | A-118524.1 | UUAUAGUGAGUUAUUUGUdTdT | 505 |
| AD-58208.1 | A-118525.1 | UCCCUCGGAAAUUGGCCUUGdTdT | 423 | A-118526.1 | AAGGCCAAUUCCAGAGGAdTdT | 506 |
| AD-58214.1 | A-118527.1 | CAAAAUAACUCACUAUAAUdTdT | 424 | A-118528.1 | AUUAUAGUGAGUUAUUUGdTdT | 507 |

TABLE 6-continued

Modified Sense and Antisense Strand Sequences of C5 dsRNAs

| Duplex ID | Sense strand | Sense sequence | SEQ ID NO: | Antisense | Antisense sequence | SEQ ID NO: | Species_Oligo name[5] |
|---|---|---|---|---|---|---|---|
| AD-58220.1 | A-118529.1 | CUCUGGAAUUGGCCUUCAdTdT | 425 | A-118530.1 | UGAAGGCCAAUUCCAGAGdTdT | 508 | |
| AD-58226.1 | A-118531.1 | GCAAGAUAUUUUAUAAUAdTdT | 426 | A-118532.1 | UAUUAUAAAAUAUCUUGCdTdT | 509 | |
| AD-58231.1 | A-118533.1 | AAUGUUUUGUCAAGUACAdTdT | 427 | A-118534.1 | UGUACUUGACAAAAACAUUdTdT | 510 | |
| AD-58191.1 | A-118535.1 | UUAAACAACAAGUACCUUUGdTdT | 428 | A-118536.1 | AAAGGUACUUGUUGUUUAAdTdT | 511 | |
| AD-58197.1 | A-118537.1 | UCAGAAAGUCUGUGAAGGAdTdT | 429 | A-118538.1 | UCCUCACAGACUUUCUGAdTdT | 512 | |
| AD-58203.1 | A-118539.1 | ACUGAAGCAUUUGAUGCAAdTdT | 430 | A-118540.1 | UUGCAUCAAAUGCUUCAGUdTdT | 513 | |
| AD-58209.1 | A-118541.1 | AGUUCUGUGUUAAAAUGUCdTdT | 431 | A-118542.1 | GACAUUUUAACACAGAACUdTdT | 514 | |
| AD-58233.1 | A-118565.1 | CfACfUfAfUfAAUfUfAUfACfUfUfGAUfUfUfdTsdT | 432 | A-118566.1 | AAAUfAAGUfAAUfAUfAGUGdTsdT | 515 | |
| AD-58193.1 | A-118567.1 | UfAACfUfCfACfUfCfAUfAAUfUfACfUfUfUfdTsdT | 433 | A-118568.1 | AAGUfAAUfAUfAGUGAGUUfAGdTsdT | 516 | |
| AD-58199.1 | A-118569.1 | ACfAAAAUfAACfUfCfACfUfAUfAUfAAdTsdT | 434 | A-118570.1 | UUfAUfAGUGAGUfAUUUUGUdTsdT | 517 | |
| AD-58205.1 | A-118571.1 | UfCfCfUfCfUfGGAAAUfUfGGCfCfUfAAUfUfdTsdT | 435 | A-118572.1 | AAGGCCfAAUUCCfAGAGGAdTsdT | 518 | |
| AD-58211.1 | A-118573.1 | CfAAAAUfAACfUfCfACfUfCfUfAAUfdTsdT | 436 | A-118574.1 | AUUfAUfAGUGAGUfAUUUUGdTsdT | 519 | |
| AD-58217.1 | A-118575.1 | CfUfCfUfGGAAAUfUfGGCfCfUfUfCfAdTsdT | 437 | A-118576.1 | UGAAGGCCfAAUUCCfAGAGdTsdT | 520 | |
| AD-58223.1 | A-118577.1 | GCfAAGAUfAUfUfUfUfAUfAAUfAdTsdT | 438 | A-118578.1 | UfAUUfAUfAAAAUfAUCUUGCdTsdT | 521 | |
| AD-58229.1 | A-118579.1 | AAUfGUfUfUfUfGUfCfAAGUfACfAdTsdT | 439 | A-118580.1 | UGUfACUUGACfAAAAACfAUUdTsdT | 522 | |
| AD-58234.1 | A-118581.1 | UfUfAAACfAACfAAGUfACfCfUfUfUfGdTsdT | 440 | A-118582.1 | AAAGfACUUGUUGUUUfAAdTsdT | 523 | |
| AD-58194.1 | A-118583.1 | UfCfAGAAAGUfCfUfGUfGAAGGAdTsdT | 441 | A-118584.1 | UCCUUCfACfAGACUUUCUGAdTsdT | 524 | |
| AD-58200.1 | A-118585.1 | ACfUfGAAGCfAUfUfUfGAUfGCfAAdTsdT | 442 | A-118586.1 | UUGCfAUCfAAAUGCUUCfAGUdTsdT | 525 | |
| AD-58206.1 | A-118587.1 | AGUfUfCfUfGUfGUfUfAAAAUfGUfCfAdTsdT | 443 | A-118588.1 | GACfAUUUfAACfACfAGAACUdTsdT | 526 | |
| AD-58236.1 | A-118423.2 | cAcuAuAAuuAcuuGAuuudTsdT | 444 | A-118644.1 | AAAUcAAGuAAUuAAuAGuGdTsdT | 527 | |
| AD-58242.1 | A-118425.2 | uAAcucAcuAuAuAuuAcuudTsdT | 445 | A-118645.1 | AAGuAAuAuAuAGuGAGUuAdTsdT | 528 | |

TABLE 6-continued

Modified Sense and Antisense Strand Sequences of C5 dsRNAs

| Duplex ID | Sense strand | Sense sequence | SEQ ID NO: | Antisense | Antisense sequence | SEQ ID NO: | Species_Oligo name[5] |
|---|---|---|---|---|---|---|---|
| AD-58248.1 | A-118427.2 | AcAAAAuAAcucAcuAuAAdTsdT | 446 | A-118646.1 | UuAuAGuGAGUuAuUuuGUdTsdT | 529 | |
| AD-58254.1 | A-118429.2 | uccucuGGAAuuGGccuudTsdT | 447 | A-118647.1 | AAGGCcAAuUUCcAGAGGAdTsdT | 530 | |
| AD-58260.1 | A-118431.2 | cAAAAuAAcucAcuAuAAudTsdT | 448 | A-118648.1 | AUuAuAGuGAGUuAuUuuGdTsdT | 531 | |
| AD-58266.1 | A-118433.2 | cucuGGAAuuGGccuucAdTsdT | 449 | A-118649.1 | uGAAGGCcAAuUUCcAGAGdTsdT | 532 | |
| AD-58272.1 | A-118435.2 | GcAAGAuAuuuuuAuAAuAdTsdT | 450 | A-118650.1 | uAUuAuAAAAAAuAUCuuGCdTsdT | 533 | |
| AD-58277.1 | A-118437.2 | AAuGuuuuuGucAAGuAcAdTsdT | 451 | A-118651.1 | uGuACuuGAcAAAAAcAuUdTsdT | 534 | |
| AD-58237.1 | A-118439.2 | uuAAAcAACAAGuAccuuudTsdT | 452 | A-118652.1 | AAAGGuACuuGuuGuUuAdTsdT | 535 | |
| AD-58243.1 | A-118441.2 | ucAGAAAGAGucuGuGAGGAdTsdT | 453 | A-118653.1 | UCCuUcAcAGACuUUCuGAdTsdT | 536 | |
| AD-58249.1 | A-118443.2 | AcuGAAGcAuuuGAuGcAAdTsdT | 454 | A-118654.1 | uuGcAUcAcAAAuGCuUcAGUdTsdT | 537 | |
| AD-58255.1 | A-118445.2 | AGuucGuGuuAAAAAuGucdTsdT | 455 | A-118655.1 | GACAuUUuAAcAcAGAACUdTsdT | 538 | |
| AD-58279.1 | A-118423.3 | cAcuAuAAuAcuuGAuuudTsdT | 456 | A-118667.1 | AAAUCAAGuAAAuAGuGAGuuadTsdT | 539 | |
| AD-58239.1 | A-118425.3 | uAAcucAcuAuAAuAcuudTsdT | 457 | A-118668.1 | AAGuAAuAuAGuGAGuuugudTsdT | 540 | |
| AD-58245.1 | A-118427.3 | AcAAAAuAcucAcuAuAAdTsdT | 458 | A-118669.1 | UuAuAGuGAGuuAuuuugudTsdT | 541 | |
| AD-58251.1 | A-118429.3 | uccucuGGAAuuGGccuudTsdT | 459 | A-118670.1 | AAGGCcAAuUCCAGGaggadTsdT | 542 | |
| AD-58257.1 | A-118431.3 | cAAAAuAAcucAcuAuAAdTsdT | 460 | A-118671.1 | AuUAuAGuGAGuuAuuuugdTsdT | 543 | |
| AD-58263.1 | A-118433.3 | cucuGGAAuuGGccuucAdTsdT | 461 | A-118672.1 | UGAAGGCCAAuuuCCAgagdTsdT | 544 | |
| AD-58269.1 | A-118435.3 | GcAAGAuAuuuuuAuAAuAdTsdT | 462 | A-118673.1 | UAuUAuAAAAAAuAuCuugcdTsdT | 545 | |
| AD-58275.1 | A-118437.3 | AAuGuuuuuGucAAGuAcAdTsdT | 463 | A-118674.1 | UGuACuUGACAAAAAcAuudTsdT | 546 | |
| AD-58280.1 | A-118439.3 | uuAAAcAACAAGuAccuuudTsdT | 464 | A-118675.1 | AAAGGuACuUGuuGuuuaadTsdT | 547 | |
| AD-58240.1 | A-118441.3 | ucAGAAAGucuGuGAAGGAdTsdT | 465 | A-118676.1 | UCCuUCACAGACuuuCugadTsdT | 548 | |
| AD-58246.1 | A-118443.3 | AcuGAAGcAuuuGAuGcAAdTsdT | 466 | A-118677.1 | UuGCAUCAAAuGCuuCagudTsdT | 549 | |
| AD-58252.1 | A-118445.3 | AGuucGuGuuAAAAAuGucdTsdT | 467 | A-118678.1 | GACAuUuUAACACAGAacudTsdT | 550 | |

[5]The Species_Oligo name and the position in the nucleotide sequence of the GenBank record that the antisense strand targets correspond to those shown in Table 5.

TABLE 7

C5 single dose screen in Hep3B cells with GalNAC conjugated iRNAs

| Duplex ID | 10 nM AVG | 0.1 nM AVG | 10 nM STDEV | 0.1 nM STDEV |
|---|---|---|---|---|
| AD-58093.1 | 15.62 | 21.60 | 7.48 | 6.52 |
| AD-58099.1 | 9.07 | 14.70 | 1.18 | 4.65 |
| AD-58105.1 | 36.71 | 60.23 | 5.07 | 19.83 |
| AD-58111.1 | 11.83 | 22.78 | 3.51 | 12.75 |
| AD-58117.1 | 12.43 | 33.46 | 2.00 | 23.56 |
| AD-58123.1 | 8.05 | 15.18 | 2.89 | 7.94 |
| AD-58129.1 | 10.77 | 40.06 | 1.30 | 19.66 |
| AD-58088.1 | 6.55 | 16.40 | 1.24 | 4.58 |
| AD-58094.1 | 19.59 | 40.68 | 7.64 | 12.30 |
| AD-58100.1 | 10.92 | 20.12 | 0.74 | 8.38 |
| AD-58106.1 | 10.97 | 37.23 | 2.49 | 19.95 |
| AD-58112.1 | 13.24 | 29.32 | 2.90 | 14.08 |
| AD-58118.1 | 6.63 | 15.23 | 0.54 | 5.72 |
| AD-58124.1 | 7.17 | 13.00 | 1.44 | 6.48 |
| AD-58130.1 | 10.38 | 17.92 | 2.36 | 6.92 |
| AD-58089.1 | 8.81 | 30.67 | 2.91 | 10.53 |
| AD-58095.1 | 8.72 | 14.66 | 1.04 | 3.37 |
| AD-58101.1 | 8.17 | 19.36 | 1.30 | 5.69 |
| AD-58107.1 | 4.84 | 18.10 | 1.66 | 7.21 |
| AD-58113.1 | 8.78 | 14.62 | 1.77 | 7.89 |
| AD-58119.1 | 8.90 | 15.01 | 0.91 | 7.35 |
| AD-58125.1 | 11.13 | 17.04 | 2.61 | 9.03 |
| AD-58131.1 | 13.50 | 40.14 | 1.08 | 12.07 |
| AD-58090.1 | 7.90 | 21.57 | 2.95 | 6.61 |
| AD-58096.1 | 8.02 | 16.56 | 1.54 | 6.68 |
| AD-58102.1 | 12.40 | 27.93 | 1.83 | 11.78 |
| AD-58108.1 | 12.02 | 15.07 | 2.88 | 5.74 |
| AD-58114.1 | 11.86 | 25.05 | 1.48 | 9.46 |
| AD-58120.1 | 7.65 | 10.57 | 0.58 | 3.56 |
| AD-58126.1 | 8.45 | 15.39 | 2.08 | 7.42 |
| AD-58132.1 | 8.50 | 19.26 | 2.52 | 9.38 |
| AD-58091.1 | 8.68 | 18.05 | 2.95 | 6.62 |
| AD-58097.1 | 9.31 | 23.02 | 0.67 | 10.10 |
| AD-58103.1 | 8.53 | 17.23 | 2.90 | 7.27 |
| AD-1955 | 57.41 | 81.16 | 10.76 | 5.29 |
| Mock | 78.61 | 75.97 | 5.70 | 2.76 |
| Untreated | 100 | 100 | 6.13 | 5.98 |

TABLE 8

C5 single dose transfection screen in primary mouse hepatocytes with GalNAC conjugated iRNAs

| Duplex ID | 10 nM AVG | 0.1 nM AVG | 10 nM STDEV | 0.1 nM STDEV |
|---|---|---|---|---|
| AD-58093.1 | 1.53 | 1.65 | 0.17 | 0.25 |
| AD-58099.1 | 1.65 | 1.50 | 0.61 | 0.22 |
| AD-58105.1 | 11.20 | 46.95 | 0.08 | 3.89 |
| AD-58111.1 | 2.49 | 2.13 | 0.26 | 0.20 |
| AD-58117.1 | 3.57 | 31.91 | 0.93 | 0.62 |
| AD-58123.1 | 4.29 | 2.97 | 0.11 | 2.22 |
| AD-58129.1 | 1.19 | 8.53 | 0.23 | 0.72 |
| AD-58088.1 | 0.84 | 1.34 | 0.68 | 0.07 |
| AD-58094.1 | 11.34 | 66.82 | 0.17 | 3.01 |
| AD-58100.1 | 2.78 | 1.51 | 0.43 | 0.33 |
| AD-58106.1 | 6.79 | 52.91 | 4.42 | 6.78 |
| AD-58121.1 | 1.94 | 2.15 | 0.04 | 0.91 |
| AD-58133.1 | 1.74 | 3.25 | 0.19 | 1.64 |
| AD-58116.1 | 1.76 | 2.21 | 1.27 | 0.78 |
| AD-1955 | 87.39 | 91.71 | 5.77 | 4.68 |
| Mock | 79.67 | 89.02 | 1.51 | 3.91 |
| Untreated | 100 | 100 | 6.39 | 13.11 |

TABLE 9

C5 single dose screen in primary Cynomolgus hepatocytes with GalNAC conjugated iRNAs

| Duplex ID | 500 nM AVG | 5 nM AVG | 500 nM STDEV | 5 nM STDEV |
|---|---|---|---|---|
| AD-58093.1 | 63.94 | 83.09 | 2.14 | 12.65 |
| AD-58099.1 | 61.34 | 85.85 | 12.32 | 21.95 |
| AD-58105.1 | 91.98 | 97.57 | 6.09 | 11.48 |
| AD-58111.1 | 71.27 | 92.28 | 1.93 | 12.72 |
| AD-58117.1 | 73.42 | 88.82 | 3.24 | 11.08 |
| AD-58123.1 | 75.14 | 73.06 | 7.72 | 9.71 |
| AD-58129.1 | 81.66 | 90.62 | 2.13 | 4.77 |
| AD-58088.1 | 53.63 | 87.03 | 5.93 | 19.86 |
| AD-58094.1 | 89.62 | 93.65 | 0.87 | 14.76 |
| AD-58100.1 | 79.56 | 96.70 | 4.31 | 1.10 |
| AD-58106.1 | 116.24 | 125.99 | 14.28 | 40.65 |
| AD-58112.1 | 97.19 | 107.81 | N/A | 3.13 |
| AD-58118.1 | 67.40 | 97.38 | 5.28 | 22.64 |
| AD-58124.1 | 58.04 | 96.14 | 8.72 | 10.64 |
| AD-58130.1 | 84.19 | 88.65 | 10.50 | 4.34 |
| AD-58089.1 | 83.83 | 83.44 | 1.91 | 12.26 |
| AD-58095.1 | 58.53 | 78.02 | 15.07 | 12.45 |
| AD-58101.1 | 76.68 | 76.73 | 3.95 | 6.35 |
| AD-58107.1 | 57.37 | 86.78 | 14.71 | 2.99 |
| AD-58113.1 | 37.79 | 71.10 | 8.27 | 7.76 |
| AD-58119.1 | 36.77 | 83.16 | 3.42 | 9.66 |
| AD-58125.1 | 72.40 | 96.53 | 4.46 | 4.96 |
| AD-58131.1 | 95.58 | 101.69 | 10.17 | 2.21 |
| AD-58090.1 | 56.37 | 75.00 | 3.21 | 4.97 |
| AD-58096.1 | 44.33 | 57.99 | 11.46 | 25.17 |
| AD-58102.1 | 95.46 | 89.35 | 0.83 | 1.76 |
| AD-58108.1 | 41.54 | 56.41 | 8.41 | 0.14 |
| AD-58114.1 | 88.32 | 101.88 | 20.02 | 30.29 |
| AD-58120.1 | 37.34 | 56.41 | 0.73 | 2.14 |
| AD-58126.1 | 84.97 | 105.90 | 2.39 | 7.96 |
| AD-58132.1 | 81.55 | 85.12 | 12.93 | 8.94 |
| AD-58091.1 | 78.88 | 84.60 | 44.66 | 17.40 |
| AD-58097.1 | 106.06 | 98.16 | 13.74 | 3.14 |
| AD-58103.1 | 57.21 | 89.46 | 6.40 | 5.93 |
| Untreated | 100 | 100 | 8.77 | 10.33 |

TABLE 10

C5 single dose free uptake screen in primary mouse hepatocytes with GalNAC conjugated iRNAs

| Duplex ID | 500 nM AVG | 5 nM AVG | 500 nM STDEV | 5 nM STDEV |
|---|---|---|---|---|
| AD-58093.1 | 31.62 | 64.91 | 7.13 | 8.39 |
| AD-58099.1 | 9.46 | 29.63 | 1.29 | 5.66 |
| AD-58105.1 | 84.77 | 96.41 | 5.22 | 1.89 |
| AD-58111.1 | 17.35 | 50.95 | 1.21 | 3.16 |
| AD-58117.1 | 94.95 | 139.52 | 15.43 | 43.39 |
| AD-58123.1 | 13.07 | 44.58 | 2.11 | 3.49 |
| AD-58129.1 | 68.87 | 85.04 | 2.62 | 4.42 |
| AD-58088.1 | 17.61 | 48.22 | 2.22 | 3.40 |
| AD-58094.1 | 95.92 | 104.23 | 4.16 | 6.53 |
| AD-58100.1 | 34.92 | 61.71 | 1.30 | 2.15 |
| AD-58106.1 | 85.26 | 107.53 | 2.30 | 3.38 |
| AD-58121.1 | 12.88 | 43.76 | 1.41 | 1.28 |
| AD-58133.1 | 20.97 | 42.76 | 0.24 | 0.11 |
| AD-58116.1 | 8.35 | 38.04 | 1.35 | 1.40 |
| Untreated | 100.00 | 100.00 | 3.85 | 4.38 |

TABLE 11

IC$_{50}$ data in primary Cynomolgus hepatocytes with GalNAC conjugated iRNAs

| Duplex ID | IC$_{50}$ (nM) | STDEV |
|---|---|---|
| AD-58099.1 | 3.131 | 1.141 |
| AD-58111.1 | 12.750 | 5.280 |

TABLE 11-continued

IC$_{50}$ data in primary Cynomolgus hepatocytes with GalNAC conjugated iRNAs

| Duplex ID | IC$_{50}$ (nM) | STDEV |
|---|---|---|
| AD-58123.1 | 0.679 | 7.587 |
| AD-58088.1 | 0.218 | 3.487 |
| AD-58113.1 | 7.296 | 3.540 |
| AD-58119.1 | 33.240 | 14.740 |
| AD-58096.1 | 10.380 | 4.199 |
| AD-58108.1 | 0.953 | 10.080 |
| AD-58120.1 | 36.170 | 88.070 |

TABLE 12

IC$_{50}$ data in primary mouse hepatocytes with GalNAC conjugated iRNAs

| Duplex ID | IC$_{50}$ (nM) | STDEV |
|---|---|---|
| AD-58099 | 3.777 | 0.122 |
| AD-58111 | 0.622 | 2.421 |
| AD-58123 | 0.549 | 1.626 |
| AD-58088 | 9.513 | 2.588 |
| AD-58121 | 2.169 | 1.176 |
| AD-58133 | 3.802 | 1.006 |
| AD-58116 | 2.227 | 0.604 |
| AD-58644.1 | 4.596 | 0.3506 |
| AD-58651.1 | 59.76 | 51.99 |
| AD-58641.1 | 0.82 | 0.2618 |
| AD-58648.1 | 7.031 | 1.256 |
| AD-58642.1 | 0.5414 | 0.7334 |
| AD-58649.1 | 3.32 | 4.922 |
| AD-58647.1 | 1.356 | 0.5215 |
| AD-58654.1 | 2.09 | 0.8338 |
| AD-58645.1 | 2.944 | 0.3315 |
| AD-58652.1 | 5.316 | 2.477 |
| AD-58643.1 | 2.179 | 1.112 |
| AD-58650.1 | 8.223 | 3.76 |
| AD-58646.1 | 2.581 | 0.8186 |
| AD-58653.1 | 2.451 | 1.249 |

TABLE 13

C5 single dose screen in Hep3B cells with modified and unmodified iRNAs

| Duplex | 1 nM AVG | 0.01 nM AVG | 1 nM STDEV | 0.01 nM STDEV |
|---|---|---|---|---|
| AD-58143.1 | 12.13 | 100.58 | 3.47 | 3.94 |
| AD-58149.1 | 10.46 | 64.97 | 0.98 | 0.00 |
| AD-58155.1 | 44.88 | 76.24 | 1.56 | 3.74 |
| AD-58161.1 | 8.51 | 102.30 | 1.06 | 0.50 |
| AD-58167.1 | 6.54 | 76.24 | 1.15 | 3.74 |
| AD-58173.1 | 6.85 | 107.44 | 0.85 | 4.74 |
| AD-58179.1 | 10.19 | 78.07 | 0.59 | 1.15 |
| AD-58185.1 | 29.46 | 79.99 | 3.64 | 0.78 |
| AD-58144.1 | 16.82 | 81.95 | 1.09 | 0.40 |
| AD-58150.1 | 11.05 | 76.20 | 2.55 | 0.00 |
| AD-58156.1 | 25.92 | 76.73 | 2.72 | 1.50 |
| AD-58162.1 | 13.25 | 71.89 | 0.43 | 3.87 |
| AD-58168.1 | 9.74 | 45.16 | 0.52 | 1.11 |
| AD-58174.1 | 4.84 | 70.14 | 0.25 | 2.75 |
| AD-58180.1 | 9.41 | 56.77 | 1.91 | 1.95 |
| AD-58186.1 | 9.97 | 68.91 | 1.03 | 0.34 |
| AD-58145.1 | 14.29 | 103.38 | 1.94 | 2.03 |
| AD-58151.1 | 10.16 | 81.17 | 1.71 | 4.77 |
| AD-58157.1 | 4.72 | 63.19 | 1.05 | 0.00 |
| AD-58163.1 | 4.95 | 40.13 | 1.65 | 0.59 |
| AD-58169.1 | 17.02 | 83.10 | 1.88 | 2.04 |
| AD-58175.1 | 8.30 | 62.54 | 0.28 | 0.31 |
| AD-58181.1 | 21.89 | 55.26 | 4.22 | 3.52 |
| AD-58187.1 | 61.96 | 71.12 | 2.61 | 2.79 |
| AD-58146.1 | 14.25 | 95.23 | 2.64 | 6.53 |
| AD-58152.1 | 11.22 | 70.09 | 0.80 | 7.88 |
| AD-58158.1 | 7.96 | 98.86 | 0.76 | 4.36 |
| AD-58164.1 | 11.60 | 43.83 | 2.06 | 3.43 |
| AD-58170.1 | 12.28 | 39.59 | 0.96 | 1.36 |
| AD-58176.1 | 6.89 | 38.77 | 1.04 | 1.33 |
| AD-58182.1 | 18.65 | 55.78 | 0.96 | 0.55 |
| AD-58188.1 | 5.40 | 69.39 | 1.07 | 0.34 |
| AD-58147.1 | 8.22 | 106.66 | 0.77 | 2.61 |
| AD-58153.1 | 68.10 | 104.17 | 4.44 | 18.29 |
| AD-58159.1 | 8.76 | 81.41 | 1.54 | 2.79 |
| AD-58190.1 | 21.94 | 77.26 | 2.23 | 0.76 |
| AD-58196.1 | 15.97 | 72.43 | 1.07 | 5.32 |
| AD-58202.1 | 11.99 | 93.83 | 5.34 | 2.76 |
| AD-58208.1 | 18.63 | 52.07 | 12.88 | 2.55 |
| AD-58214.1 | 6.85 | 94.15 | 0.51 | 2.31 |
| AD-58220.1 | 11.50 | 78.34 | 3.85 | 0.77 |
| AD-58226.1 | 5.77 | 57.75 | 1.71 | 1.13 |
| AD-58231.1 | 7.23 | 75.67 | 1.07 | 0.74 |
| AD-58191.1 | 35.40 | 66.17 | 5.50 | 4.21 |
| AD-58197.1 | 12.05 | 67.49 | 1.70 | 0.33 |
| AD-58203.1 | 15.16 | 66.80 | 1.46 | 1.31 |
| AD-58209.1 | 7.58 | 71.23 | 3.58 | 6.28 |
| AD-58233.1 | 27.01 | 86.02 | 0.86 | 0.42 |
| AD-58193.1 | 15.37 | 99.85 | 1.44 | 0.00 |
| AD-58199.1 | 21.52 | 78.39 | 6.02 | 16.40 |
| AD-58205.1 | 24.13 | 78.88 | 5.46 | 0.77 |
| AD-58211.1 | 16.38 | 32.37 | 2.61 | 0.48 |
| AD-58217.1 | 12.23 | 70.16 | 0.29 | 3.44 |
| AD-58223.1 | 8.51 | 72.85 | 3.01 | 1.79 |
| AD-58229.1 | 5.50 | 75.93 | 1.96 | 0.37 |
| AD-58234.1 | 46.86 | 101.94 | 15.59 | 0.00 |
| AD-58194.1 | 14.49 | 107.05 | 2.47 | 4.20 |
| AD-58200.1 | 16.21 | 61.04 | 0.96 | 1.20 |
| AD-58206.1 | 13.25 | 37.73 | 2.82 | 2.03 |
| AD-58236.1 | 8.29 | 119.17 | 1.16 | 2.92 |
| AD-58242.1 | 12.05 | 102.69 | 0.44 | 4.03 |
| AD-58248.1 | 62.78 | 83.41 | 15.22 | 3.27 |
| AD-58254.1 | 11.18 | 100.54 | 1.59 | 0.00 |
| AD-58260.1 | 8.42 | 71.84 | 1.10 | 0.35 |
| AD-58266.1 | 14.05 | 92.21 | 1.91 | 2.26 |
| AD-58272.1 | 22.63 | 81.11 | 1.62 | 1.59 |
| AD-58277.1 | 70.51 | 75.67 | 4.80 | 0.74 |
| AD-58237.1 | 28.10 | 98.56 | 1.96 | 5.79 |
| AD-58243.1 | 14.16 | 86.05 | 1.11 | 2.95 |
| AD-58249.1 | 77.08 | 96.45 | 15.14 | 0.95 |
| AD-58255.1 | 12.27 | 47.89 | 2.58 | 0.00 |
| AD-58279.1 | 25.78 | 94.13 | 5.52 | 0.46 |
| AD-58239.1 | 22.98 | 83.45 | 0.28 | 4.91 |
| AD-58245.1 | 89.60 | 90.93 | 15.24 | 0.45 |
| AD-58251.1 | 28.39 | 86.32 | 7.29 | 0.00 |
| AD-58257.1 | 48.97 | 64.53 | 9.10 | 1.90 |
| AD-58263.1 | 9.14 | 83.39 | 1.27 | 1.63 |
| AD-58269.1 | 83.84 | 75.94 | 15.90 | 1.12 |
| AD-58275.1 | 10.29 | 86.32 | 0.73 | 0.85 |
| AD-58280.1 | 72.77 | 110.04 | 7.44 | 3.24 |
| AD-58240.1 | 65.42 | 75.69 | 3.82 | 2.23 |
| AD-58246.1 | 59.19 | 65.88 | 28.95 | 0.65 |
| AD-58252.1 | 15.35 | 97.26 | 1.14 | 7.62 |
| Mock | 76.53 | 66.57 | 14.26 | 4.72 |
| AD-1955 | 72.30 | 82.72 | 19.54 | 49.99 |
| Untreated | 100.00 | 100.00 | 21.68 | 26.78 |

TABLE 14

C5 single dose screen in primary mouse hepatocytes with modified and unmodified iRNAs

| Duplex ID | 1 nM AVG | 0.1 nM AVG | 1 nM STDEV | 0.1 nM STDEV |
|---|---|---|---|---|
| AD-58143.1 | 4.51 | 81.77 | 3.13 | 8.75 |
| AD-58149.1 | 4.65 | 73.16 | 3.14 | 20.17 |

TABLE 14-continued

C5 single dose screen in primary mouse hepatocytes with modified and unmodified iRNAs

| Duplex ID | 1 nM AVG | 0.1 nM AVG | 1 nM STDEV | 0.1 nM STDEV |
|---|---|---|---|---|
| AD-58155.1 | 65.56 | 79.74 | 4.66 | 9.36 |
| AD-58161.1 | 16.82 | 81.11 | 6.22 | 7.43 |
| AD-58167.1 | 4.72 | 77.12 | 1.17 | 14.25 |
| AD-58173.1 | 5.57 | 76.00 | 3.14 | 13.52 |
| AD-58179.1 | 14.55 | 77.88 | 1.44 | 18.40 |
| AD-58185.1 | 15.69 | 72.59 | 8.67 | 7.81 |
| AD-58144.1 | 8.70 | 91.49 | 0.90 | 7.08 |
| AD-58150.1 | 12.51 | 84.01 | 1.64 | 8.20 |
| AD-58156.1 | 18.23 | 97.32 | 1.47 | 19.50 |
| AD-58162.1 | 7.72 | 78.89 | 5.19 | 13.80 |
| AD-58190.1 | 11.86 | 92.80 | 2.82 | 4.41 |
| AD-58196.1 | 7.27 | 82.71 | 1.39 | 31.81 |
| AD-58202.1 | 10.67 | 87.11 | 1.04 | 35.79 |
| AD-58208.1 | 32.21 | 74.39 | 8.60 | 27.45 |
| AD-58214.1 | 4.24 | 67.63 | 0.45 | 17.85 |
| AD-58220.1 | 13.64 | 96.14 | 4.56 | 14.36 |
| AD-58226.1 | 3.83 | 63.44 | 1.30 | 11.94 |
| AD-58231.1 | 5.95 | 82.24 | 2.80 | 17.36 |
| AD-58191.1 | 14.50 | 99.50 | 5.48 | 5.53 |
| AD-58197.1 | 16.12 | 93.09 | 0.81 | 3.21 |
| AD-58203.1 | 12.52 | 104.63 | 5.98 | 6.02 |
| AD-58209.1 | 8.79 | 59.35 | 3.05 | 13.07 |
| AD-58233.1 | 9.50 | 64.26 | 5.69 | 8.70 |
| AD-58193.1 | 8.88 | 89.60 | 3.36 | 3.08 |
| AD-58199.1 | 13.56 | 87.14 | 2.18 | 6.44 |
| AD-58205.1 | 46.84 | 89.13 | 4.48 | 17.16 |
| AD-58211.1 | 13.10 | 111.62 | 1.10 | 21.54 |
| AD-58217.1 | 29.79 | 117.49 | 11.85 | 20.41 |
| AD-58223.1 | 20.53 | 105.44 | 1.94 | 2.98 |
| AD-58229.1 | 13.76 | 98.15 | 1.05 | 9.03 |
| AD-58234.1 | 12.33 | 71.34 | 0.72 | 4.17 |
| AD-58194.1 | 14.02 | 90.60 | 1.39 | 15.64 |
| AD-58200.1 | 5.25 | 90.95 | 1.37 | 31.70 |
| AD-58206.1 | 8.19 | 109.47 | 3.99 | 21.75 |
| AD-58236.1 | 2.07 | 70.19 | 0.80 | 20.59 |
| AD-58242.1 | 4.76 | 53.26 | 1.59 | 11.56 |
| AD-58248.1 | 62.42 | 78.23 | 5.47 | 25.85 |
| AD-58254.1 | 16.47 | 70.22 | 2.92 | 21.74 |
| AD-58260.1 | 2.84 | 75.65 | 0.38 | 11.59 |
| AD-58266.1 | 40.70 | 89.88 | 16.05 | 11.57 |
| AD-58272.1 | 21.42 | 59.44 | 13.29 | 10.98 |
| AD-58277.1 | 71.72 | 121.44 | 16.35 | 21.16 |
| AD-58237.1 | 11.85 | 112.68 | 9.22 | 12.88 |
| AD-58243.1 | 10.46 | 90.64 | 3.42 | 4.33 |
| AD-58249.1 | 71.47 | 113.30 | 4.30 | 3.84 |
| AD-58255.1 | 6.86 | 78.55 | 2.22 | 28.37 |
| AD-58279.1 | 7.15 | 74.96 | 2.84 | 4.72 |
| AD-58239.1 | 13.64 | 106.45 | 1.87 | 8.25 |
| AD-58245.1 | 68.67 | 112.08 | 21.89 | 7.73 |
| AD-58251.1 | 47.01 | 133.20 | 4.69 | 7.14 |
| AD-58257.1 | 30.68 | 87.51 | 2.87 | 32.84 |
| AD-58263.1 | 7.22 | 83.23 | 2.55 | 37.50 |
| AD-58269.1 | 78.90 | 106.06 | 5.07 | 3.04 |
| AD-58275.1 | 8.92 | 95.77 | 1.91 | 7.14 |
| AD-58280.1 | 16.67 | 78.47 | 4.15 | 6.06 |
| AD-58240.1 | 71.03 | 138.54 | 5.32 | 10.87 |
| AD-58246.1 | 71.87 | 89.02 | 4.95 | 8.63 |
| AD-58252.1 | 4.04 | 56.10 | 1.23 | 12.02 |
| Mock | 66.84 | 82.81 | 2.75 | 17.19 |
| AD-1955 | 87.44 | 102.07 | 3.64 | 4.08 |
| Untreated | 100.00 | 100.00 | 15.25 | 18.37 |

TABLE 15

IC$_{50}$ data in Hep3B cells with modified and unmodified iRNAs

| Duplex ID | IC$_{50}$ (pM) | STDEV |
|---|---|---|
| AD-58143.1 | 36.35 | 12.26 |
| AD-58149.1 | 5.735 | 6.196 |
| AD-58161.1 | 78.12 | 26.64 |
| AD-58167.1 | 31.03 | 18.14 |
| AD-58173.1 | 29.12 | 16.53 |
| AD-58236.1 | 52.73 | 32.02 |
| AD-58242.1 | 8.859 | 4.321 |
| AD-58260.1 | 7.706 | 5.094 |
| AD-58263.1 | 96.64 | 47.61 |

TABLE 16

IC$_{50}$ data in primary mouse hepatocytes with modified and unmodified iRNAs

| Duplex ID | IC$_{50}$ (pM) | STDEV |
|---|---|---|
| AD-58260.1 | 1.015 | 0.9676 |
| AD-58149.1 | 1.309 | 1.749 |
| AD-58167.1 | 1.991 | 2.477 |
| AD-58242.1 | 0.5866 | 1.8 |
| AD-58236.1 | 0.4517 | 0.06392 |
| AD-58143.1 | 0.8876 | 0.1613 |
| AD-58279.1 | 3.116 | 0.7368 |
| AD-58252.1 | 7.153 | 1.021 |
| AD-58173.1 | 7.144 | 19.88 |
| AD-58263.1 | 3.224 | 5.478 |

Example 3

In Vivo Screening

A subset of seven GalNAC conjugated iRNAs was selected for further in vivo evaluation.

C57BL/6 mice (N=3 per group) were injected subcutaneously with 10 mg/kg of GalNAc conjugated duplexes or an equal volume of 1× Dulbecco's Phosphate-Buffered Saline (DPBS) (Life Technologies, Cat#14040133). Forty-eight hours later, mice were euthanized and the livers were dissected and flash frozen in liquid nitrogen. Livers were ground in a 2000 Geno/Grinder (SPEX SamplePrep, Metuchen, N.J.). Approximately 10 mg of liver powder per sample was used for RNA isolation. Samples were first homogenized in a TissueLyserII (Qiagen Inc, Valencia, Calif.) and then RNA was extracted using a RNeasy 96 Universal Tissue Kit (Qiagen Inc., Cat#74881) following manufacturer's protocol using vacuum/spin technology. RNA concentration was measured by a NanoDrop 8000 (Thermo Scientific, Wilmington, Del.) and was adjusted to 100 ng/µl. cDNA and RT-PCR were performed as described above.

Figure 2:
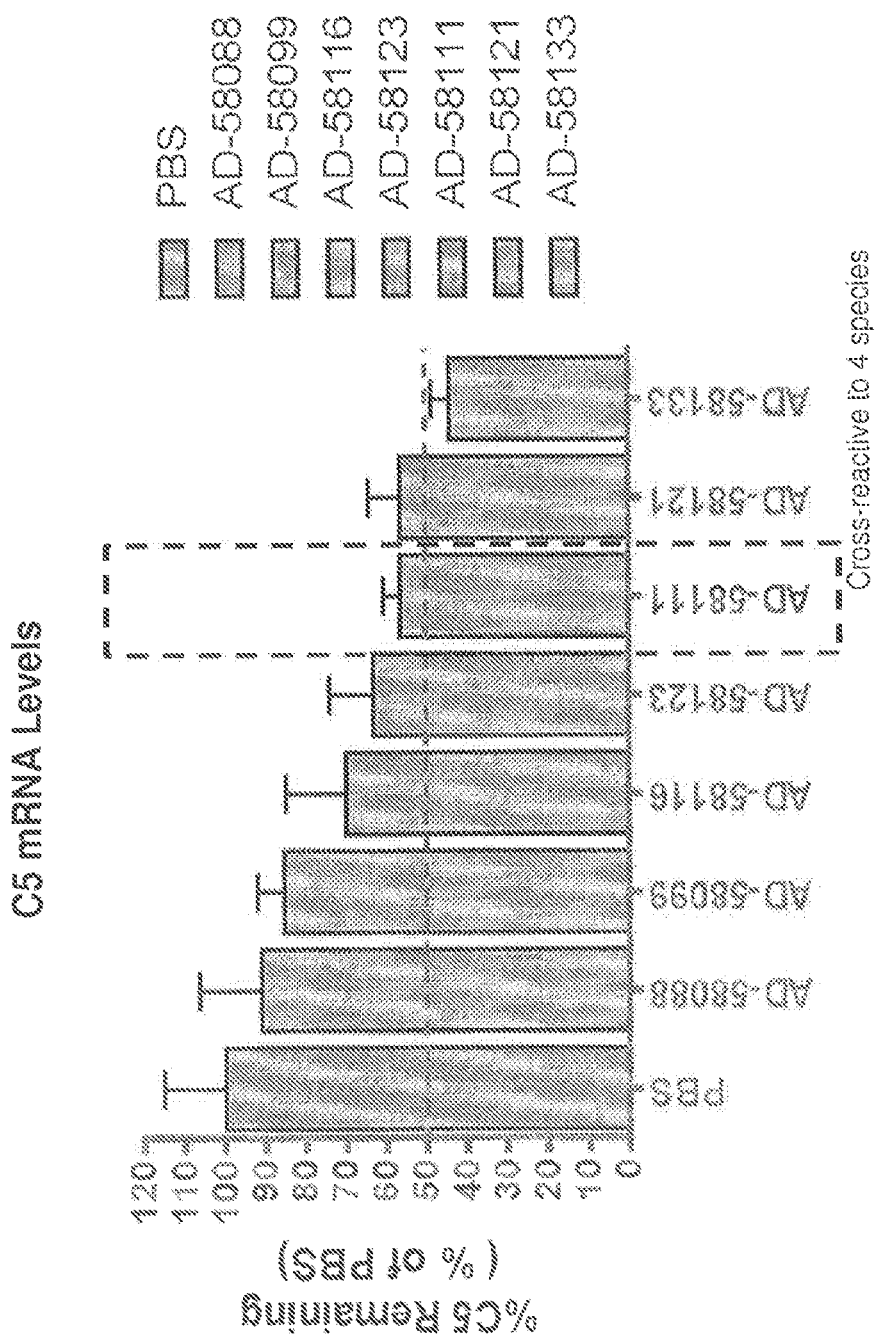
FIG. 2 is a graph showing the percentage of complement component C5 remaining in C57BL/6 mice following a single 10 mg/kg dose of the indicated iRNAs.

The results of the single dose screen are depicted in FIG. 2. Table 17 shows the results of an in vivo single dose screen with the indicated GalNAC conjugated modified iRNAs. Data are expressed as percent of mRNA remaining relative to DPBS treated mice. The "Experiments" column lists the number of experiments from which the average was calculated. The standard deviation is calculated from all mice in a group across all experiments analyzed.

TABLE 17

In vivo C5 single dose screen

| Duplex ID | Experiments | AVG | STDEV |
|---|---|---|---|
| AD-58088.2 | 2 | 82.66 | 13.54 |
| AD-58644.1 | 1 | 37.79 | 9.63 |

TABLE 17-continued

In vivo C5 single dose screen

| Duplex ID | Experiments | AVG | STDEV |
|---|---|---|---|
| AD-58651.1 | 1 | 75.33 | 5.21 |
| AD-58099.2 | 2 | 71.94 | 15.45 |
| AD-58641.1 | 1 | 20.09 | 4.09 |
| AD-58648.1 | 1 | 48.43 | 9.07 |
| AD-58111.2 | 3 | 67.17 | 13.60 |
| AD-58642.1 | 2 | 21.78 | 5.32 |
| AD-58649.1 | 1 | 45.30 | 14.02 |
| AD-58116.2 | 2 | 70.16 | 10.32 |
| AD-58647.1 | 1 | 26.77 | 4.14 |
| AD-58654.1 | 1 | 50.06 | 27.85 |
| AD-58121.2 | 2 | 52.56 | 13.00 |
| AD-58645.1 | 1 | 24.60 | 1.29 |
| AD-58652.1 | 1 | 52.67 | 3.87 |
| AD-58123.2 | 2 | 65.70 | 9.60 |
| AD-58643.1 | 1 | 23.21 | 2.41 |
| AD-58650.1 | 1 | 46.75 | 14.10 |
| AD-58133.2 | 3 | 51.98 | 13.45 |
| AD-58646.1 | 2 | 28.67 | 5.34 |
| AD-58653.1 | 1 | 43.02 | 10.61 |
| PBS | 3 | 100.00 | 9.03 |

Figure 3:
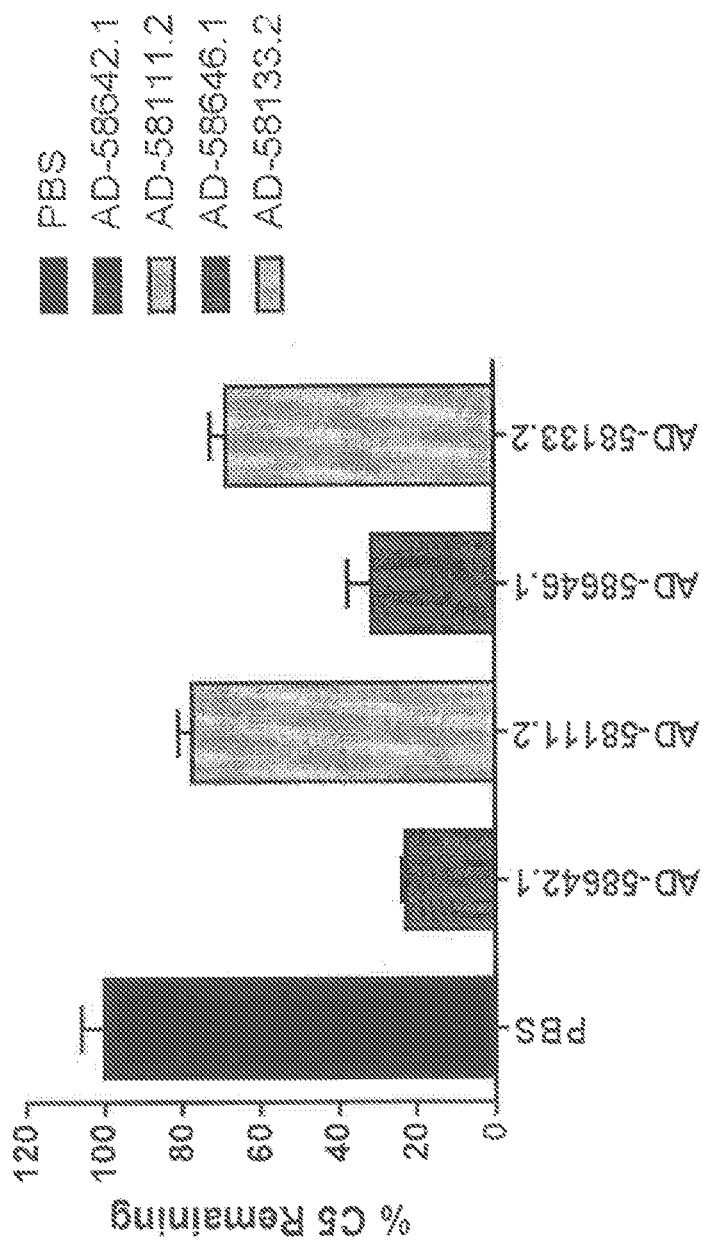
FIG. 3 is a graph showing the percentage of complement component C5 remaining in C57BL/6 mice following a single 10 mg/kg dose of the indicated iRNAs.

Two of the most efficacious GalNAC conjugated iRNAs were further modified to include additional phosphorothioate linkages (Table 18) and the efficacy of these duplexes was determined in vivo as described above. The results of the single dose screen are depicted in FIG. 3 and demonstrate that the iRNA agents with additional phosphorothiate linkages are more efficacious than those iRNA agents without or with fewer phosphorothioate linkages.

serum and incubated with antibody-coated sheep red blood cells for 1 hour. The hemoglobin absorbance was measured and the % hemolysis as compared to a reference curve (prepared using a dilution series of mouse serum) was calculated.

The efficacy of AD-58642 in vivo was also assayed in mice following a single subcutaneous injection of 1.25 mg/kg, 2.5 mg/kg, 5 mg/kg, 10 mg/kg, and 25 mg/kg of AD-58642. At day 5 C5 mRNA was assayed in liver samples using qPCR, C5 activity was assayed for hemolysis, and the amount of C5 protein was determined by Western blot analysis of whole serum.

Figure 6B:
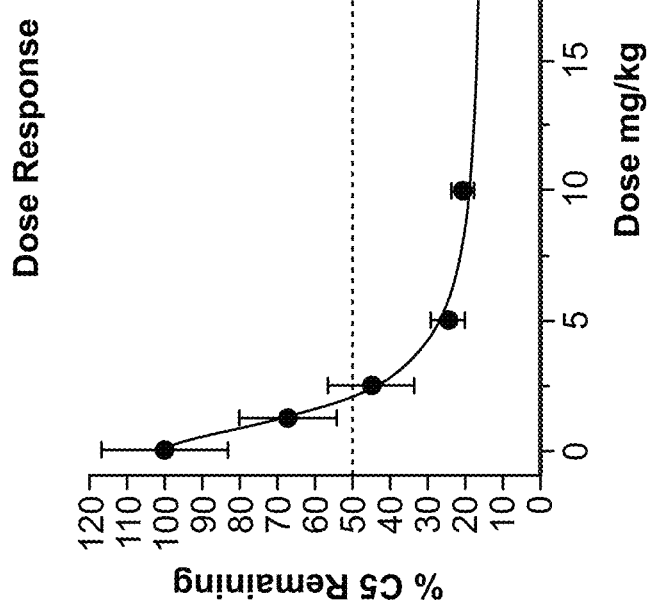
FIG. 6B is a graph showing the percentage of complement component C5 remaining in C57BL/6 mice 5 days after a single 1.25 mg/kg, 2.5 mg/kg, 5 mg/kg, 10 mg/kg or 25 mg/kg dose of AD-58642.
Figure 6A:
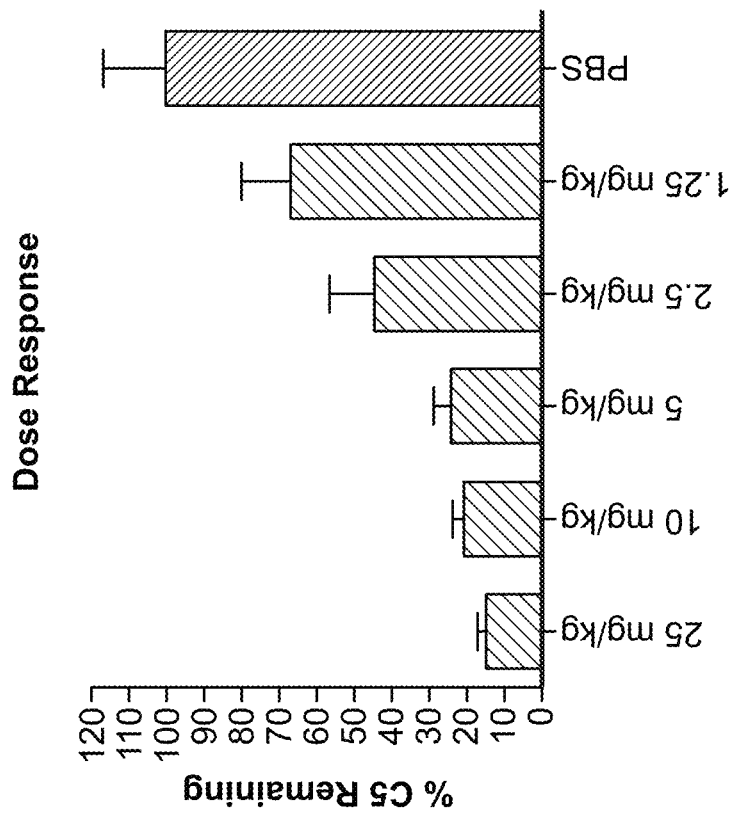
FIG. 6A is a graph showing the percentage of complement component C5 remaining in C57BL/6 mice 5 days after a single 1.25 mg/kg, 2.5 mg/kg, 5 mg/kg, 10 mg/kg or 25 mg/kg dose of AD-58642.

As depicted in FIGS. 6A and 6B, although there is only a minor improvement (i.e., about 5%) in efficacy of AD-58642 to inhibit C5 mRNA at a dose of 25 mg/kg as compared to a 10 mg/kg dose, there is an average of 85% silencing with a 25 mg/kg dose. In addition, there is a dose response effect with an $IC_{50}$ of about 2.5 mg/kg.

Figure 7A:
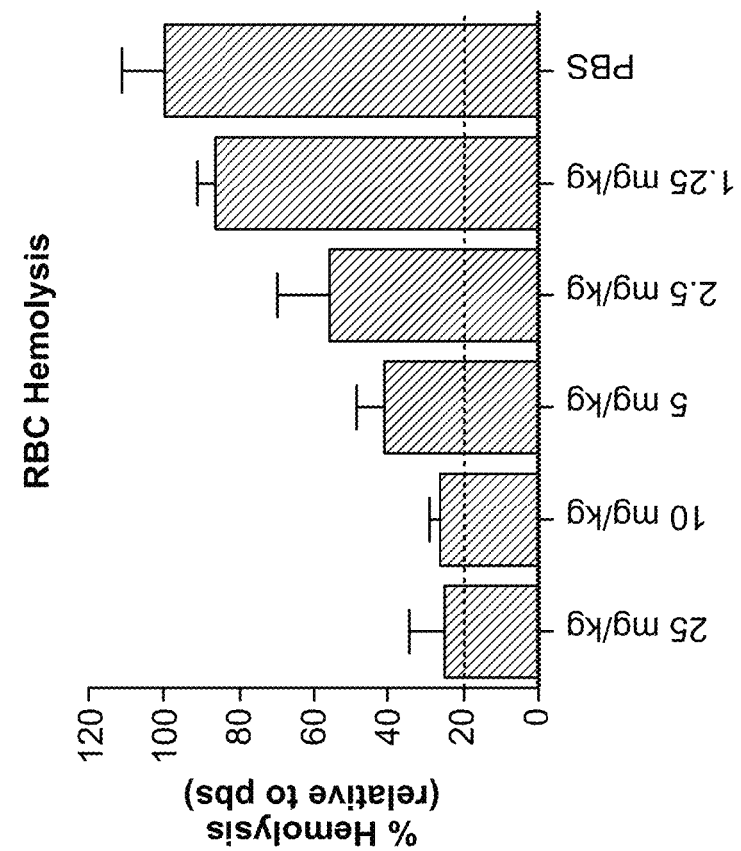
FIG. 7A is a graph showing the percentage of hemolysis remaining at day 5 in C57BL/6 mice after a single 1.25 mg/kg, 2.5 mg/kg, 5 mg/kg, 10 mg/kg or 25 mg/kg dose of AD-58642.
Figure 7B:
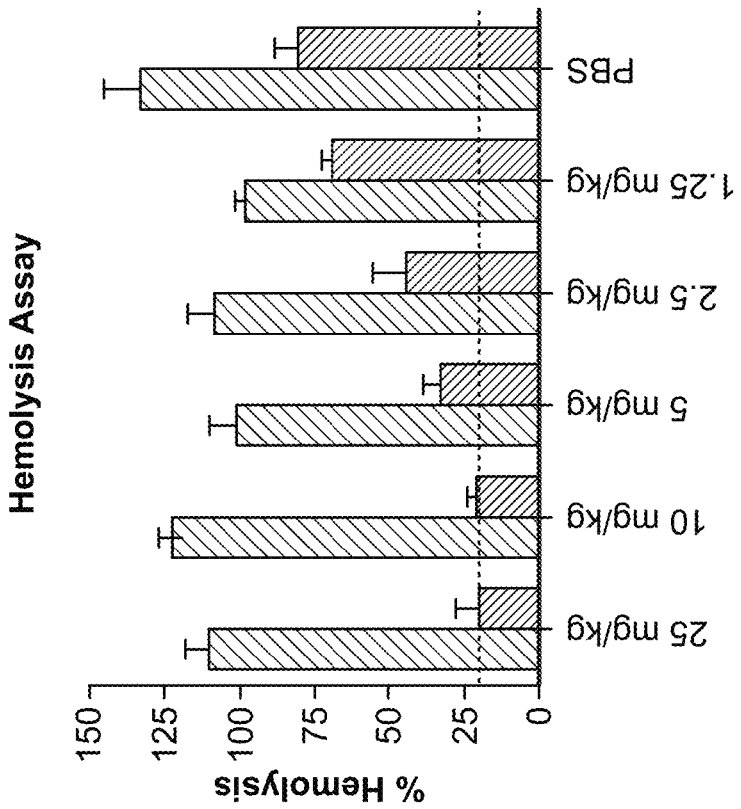
FIG. 7B is a graph showing the percentage of hemolysis remaining at day 5 in C57BL/6 mice after a single 1.25 mg/kg, 2.5 mg/kg, 5 mg/kg, 10 mg/kg or 25 mg/kg dose of AD-58642.
Figure 8:
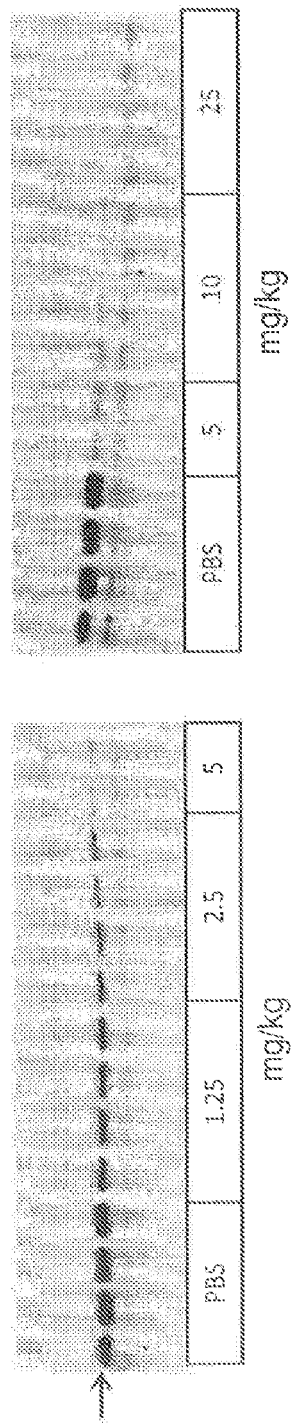
FIG. 8 is a Western blot showing the amount of complement component C5 remaining at day 5 in C57BL/6 mice after a single 1.25 mg/kg, 2.5 mg/kg, 5 mg/kg, 10 mg/kg or 25 mg/kg dose of AD-58642.
Figure 8:
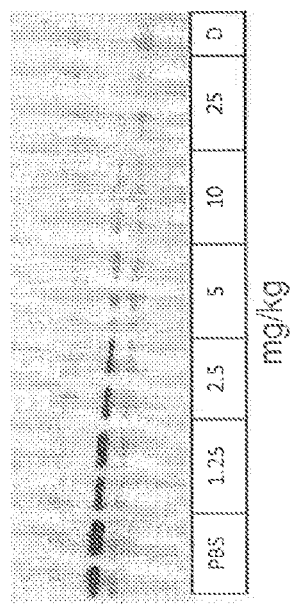

FIGS. 7A and 7B and 8 demonstrate that AD-58642 is efficacious for decreasing the amount of C5 protein (FIG. 8) and C5 protein activity (FIGS. 7A and 7B).

Figure 9:
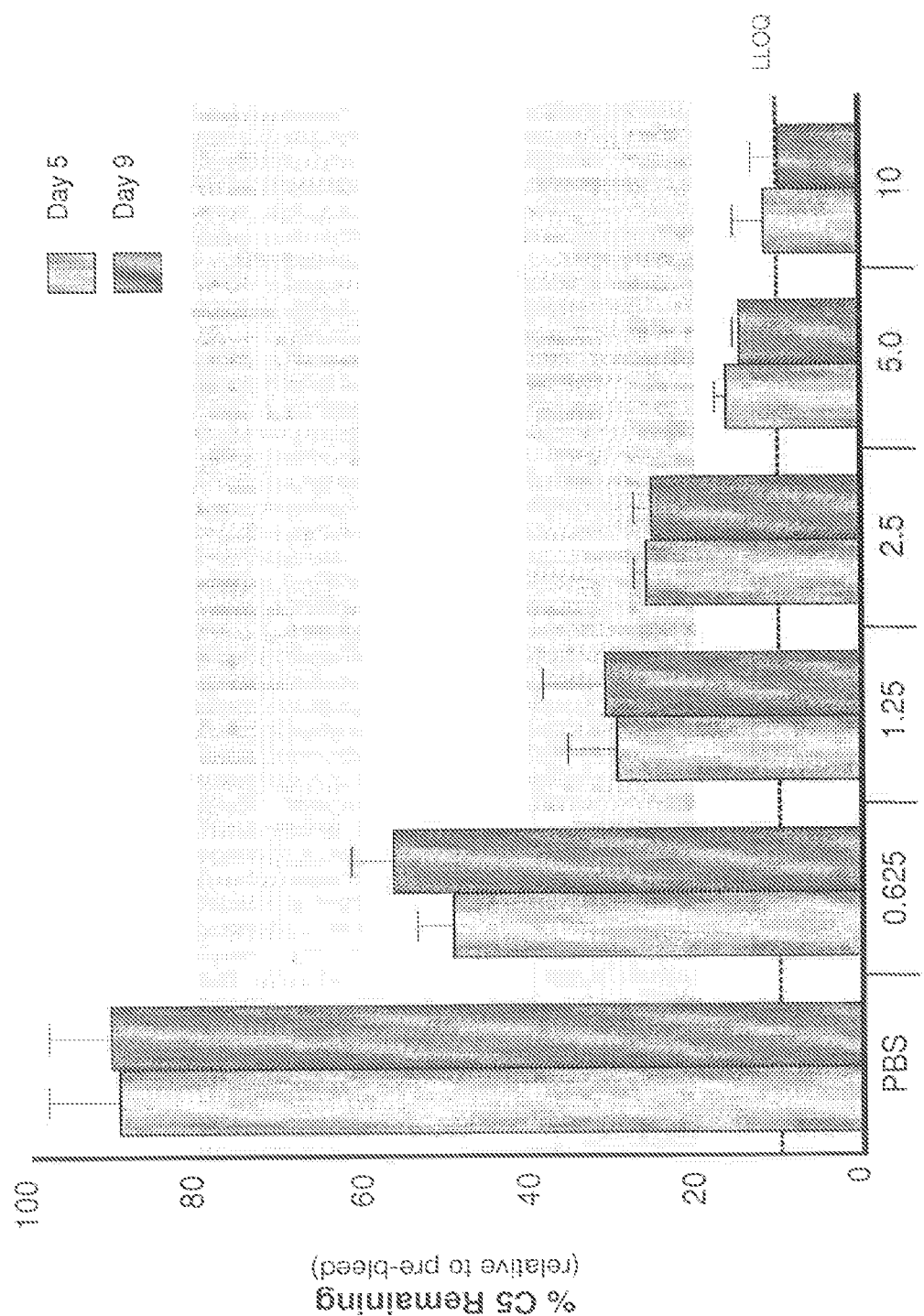
FIG. 9 is a graph showing the amount of complement component C5 protein remaining at days 5 and 9 in mouse serum after a single 0.625 mg/kg, 1.25 mg/kg, 2.5 mg/kg, 5.0 mg/kg, or 10 mg/kg dose of AD-58641. The lower limit of quantitation (LLOQ) of the assay is shown as a dashed line.

The duration of silencing of AD-58641 in vivo was also determined by subcutaneously administering a single 0.625 mg/kg, 1.25 mg/kg, 2.5 mg/kg, 5.0 mg/kg, or 10 mg/kg dose of AD-58641 to C57Bl/6 (n=3) mice and determining the amount of C5 protein present in these animals on days 5 and 9 by ELISA. Briefly, serum was collected on day 0, pre-bleed, day 5, and day 9 and the levels of C5 proteins were quantified by ELISA. C5 protein levels were normalized to the day 0 pre-bleed level. As depicted in FIG. 9, the results demonstrate that there is a dose dependent potent and durable knock-down of C5 serum protein. (The single dose $ED_{50}$ was 0.6 mg/kg).

TABLE 18

Phosphorothioate Modifed GalNAC Conjugated C5 iRNAs

| Duplex ID | Sense strand | Sense sequence | SEQ ID NO: Antisense | Antisense sequence | SEQ ID NO: Cross Reactivity |
|---|---|---|---|---|---|
| AD-58642.1 | A-119324.1 | GfsasCfaAfaAfuAfAfCfu CfaCfuAfuAfaUfL96 | 551 A-119325.1 | asUfsuAfuAfgUfgAfguu AfuUfuUfgUfcsasa | 555 HumRheMusRat |
| AD-58111.2 | A-118316.1 | GfaCfaAfaAfuAfAfCfuCfa CfuAfuAfaUfL96 | 552 A-118317.1 | aUfuAfuAfgUfgAfguu AfuUfuUfgUfcsAfsa | 556 HumRheMusRat |
| AD-58646.1 | A-119332.1 | CfsasGfaUfcAfaAfCfAfc AfaUfuUfcAfgUfL96 | 553 A-119333.1 | asCfsuGfaAfaUfuGfugu UfuGfaUfcUfgscsa | 557 MusRat |
| AD-58133.2 | A-118386.1 | CfaGfaUfcAfaAfCfAfc AfaUfuUfcAfgUfL96 | 554 A-118387.1 | aCfuGfaAfaUfuGfugu UfuGfaUfcUfgsCfsa | 558 MusRat |

Figure 4:
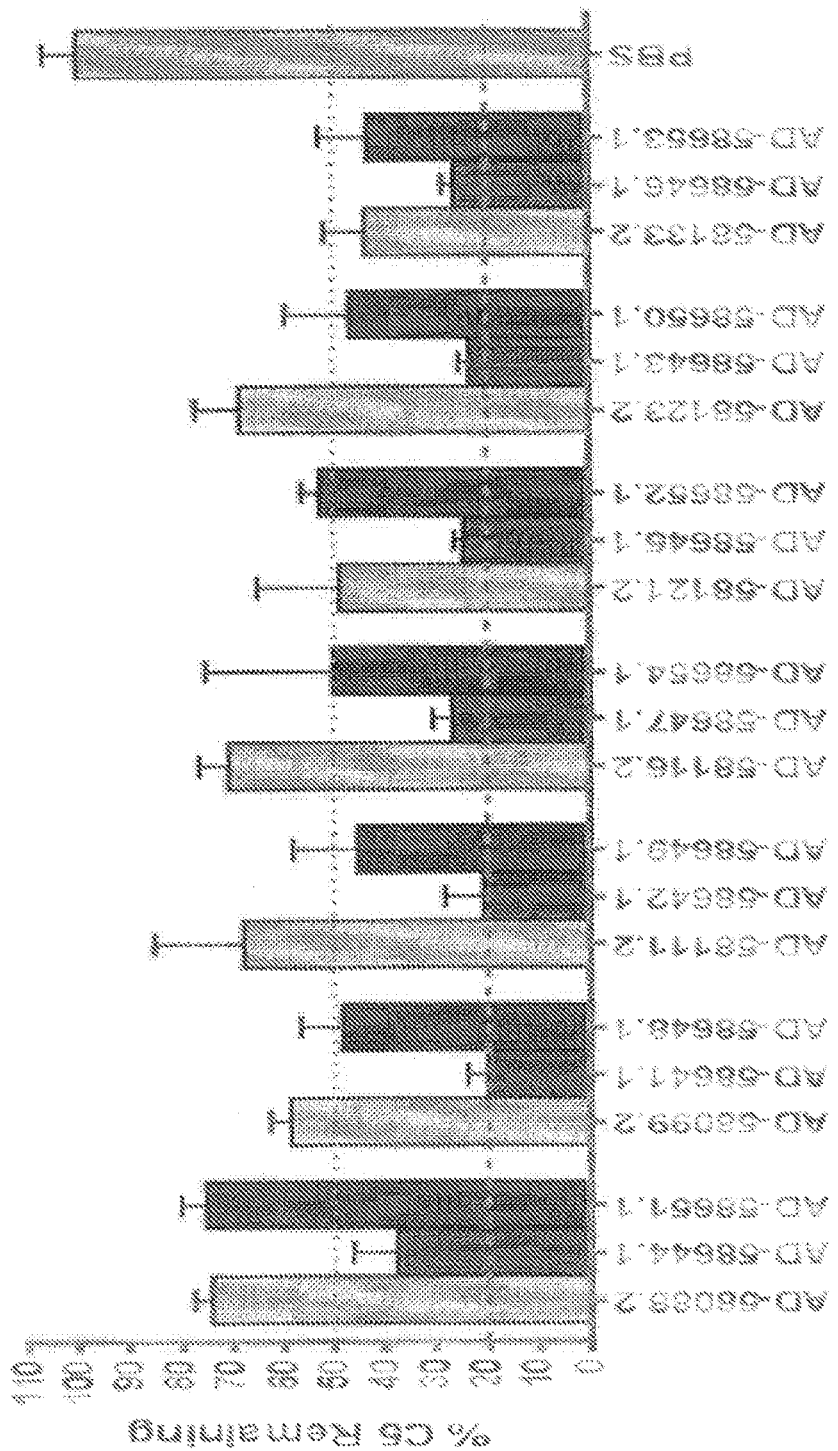
FIG. 4 is a graph showing the percentage of complement component C5 remaining in C57BL/6 mice 48 hours after a single 10 mg/kg dose of the indicated iRNAs.

Given the impact of the additional phosphorothioate linkages on the silencing ability of the iRNA agents described above, the efficacy of additional GalNAC conjugated iRNA duplexes including phosphoriothioate linkages (Table 19) was determined in vivo as described above. The results of this single dose screen are depicted in FIG. 4.

Figure 5A:
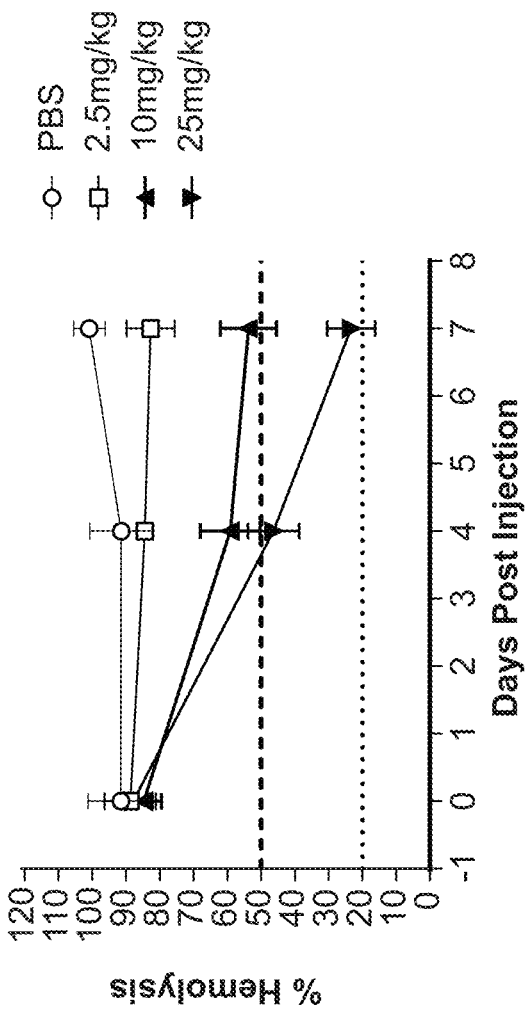
FIG. 5A is a graph showing the percentage of hemolysis remaining at days 4 and 7 in rats after a single 2.5 mg/kg, 10 mg/kg, or 25 mg/kg subcutaneous dose of AD-58642.
Figure 5B:
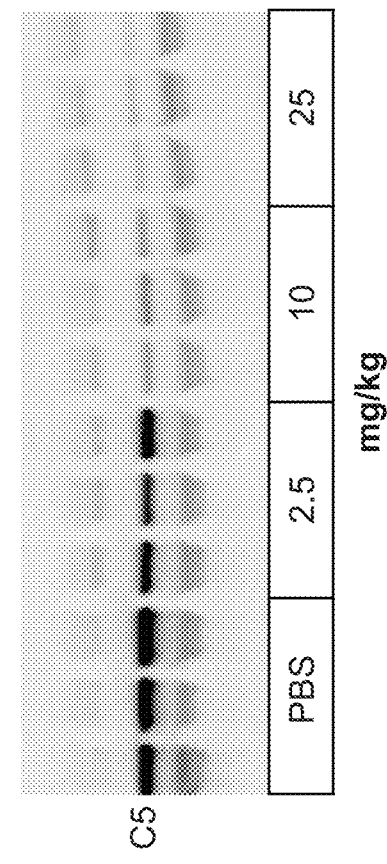
FIG. 5B is a Western blot showing the amount of complement component C5 remaining at day 7 in rats after a single 2.5 mg/kg, 10 mg/kg, or 25 mg/kg subcutaneous dose of AD-58642.

The duration of silencing of AD-58642 in vivo was determined by administering a single 2.5 mg/kg, 10 mg/kg, or 25 mg/kg dose to rats and determining the amount of C5 protein (FIG. 5B) present on day 7 and the activity of C5 protein (FIG. 5A) present on days 4 and 7. As demonstrated in FIG. 5, there is a 50% reduction in the activity of C5 protein by Day 4 at a 25 mg/kg dose and at Day 7, a greater than 70% reduction in the activity of C5 protein.

Figure 10:
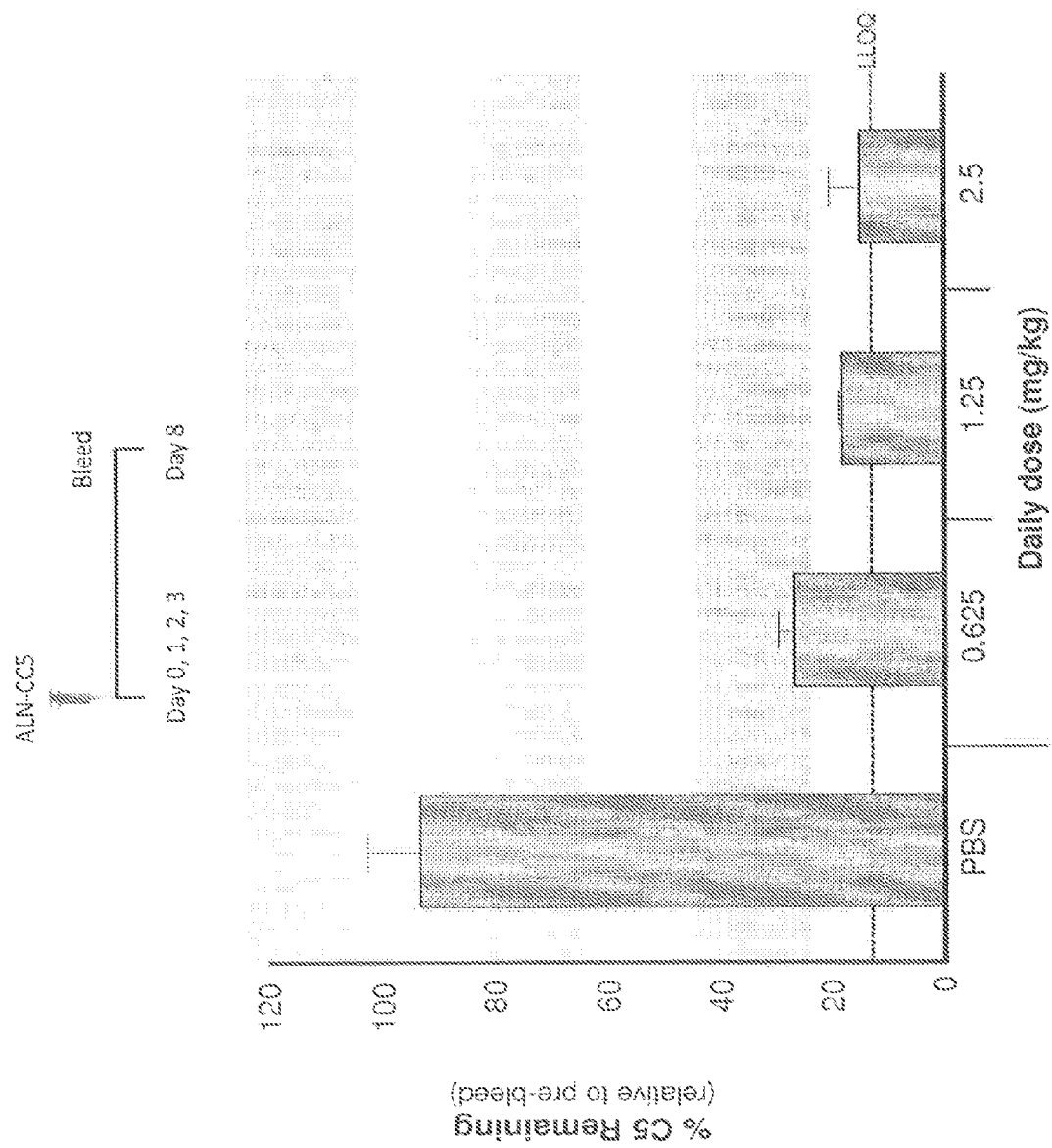
FIG. 10 is a is a graph showing the amount of complement component C5 protein remaining at day 8 in mouse serum after a 0.625 mg/kg, 1.25 mg/kg, or 2.5 mg/kg dose of AD-58641 at days 0, 1, 2, and 3. The lower limit of quantitation (LLOQ) of the assay is shown as a dashed line.

The amount of C5 protein was determined by Western blot analysis of whole serum. The activity of C5 protein was determined by a hemolysis assay. Briefly, a fixed dilution of human C5 depleted human serum was mixed with mouse Compound AD-58641 was also tested for efficacy in C57Bl/6 mice using a multi-dosing administration protocol. Mice were subcutaneously administered compound AD-58641 at a 0.625 mg/kg, 1.25 mg/kg, or 2.5 mg/kg dose at days 0, 1, 2, and 3. Serum was collected at days 0 and 8 as illustrated in FIG. 10 and analyzed for C5 protein levels by ELISA. C5 levels were normalized to the day 0 pre-bleed level. FIG. 10 shows that multi-dosing of AD-58641 achieves silencing of C5 protein at all of the does tested, with a greater than 90% silencing of C5 protein at a dose of 2.5 mg/kg.

Figure 11A:
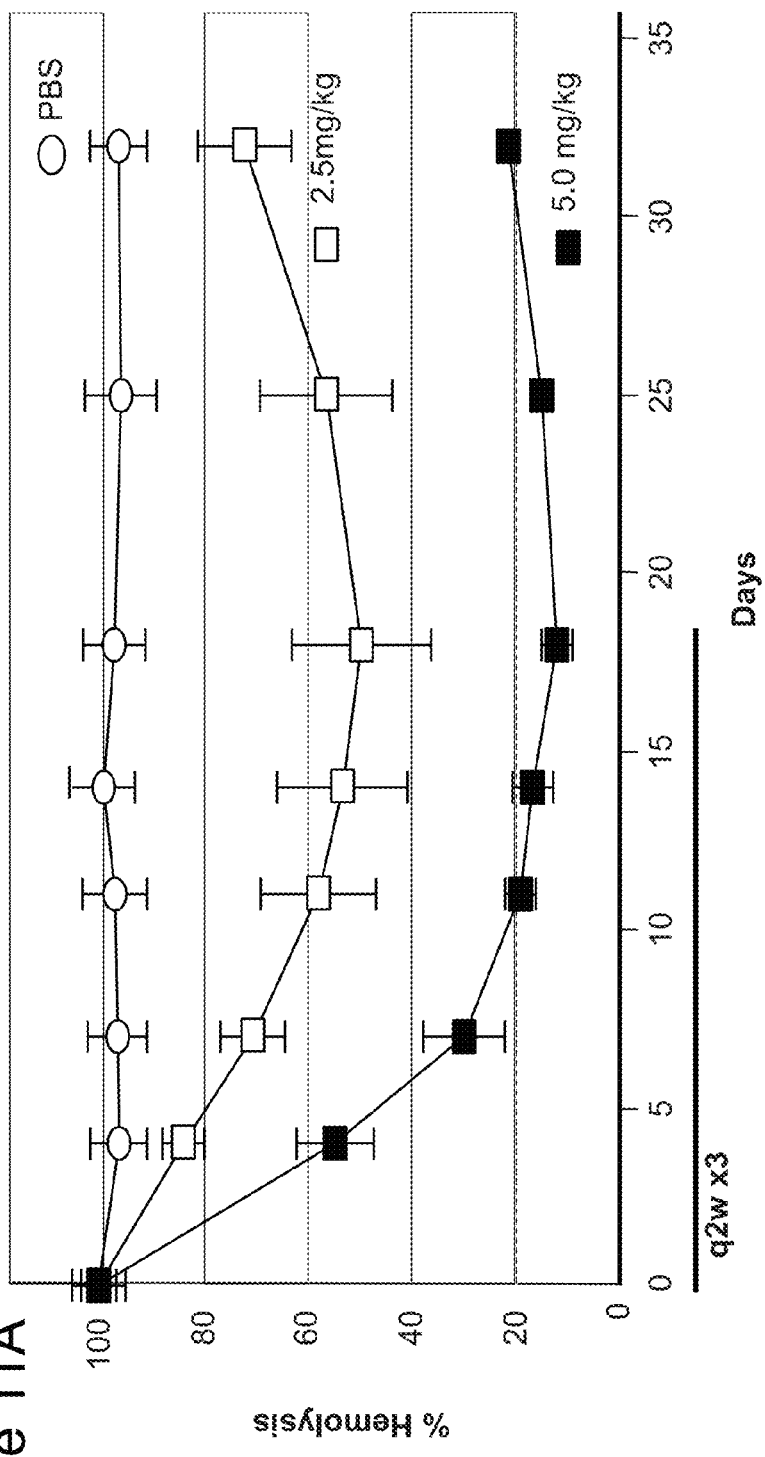
FIG. 11A is graph demonstrating the efficacy and cumulative effect of repeat administration of compound AD-58641 in rats and depicts the hemolytic activity remaining in the serum of rats on days 0, 4, 7, 11, 14, 18, 25, and 32 after repeat administration at 2.5 mg/kg/dose or 5.0 mg/kg/dose, q2w×3 (twice a week for 3 weeks).
Figure 11B:
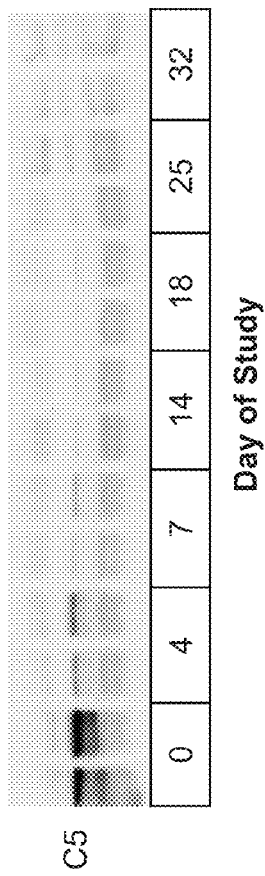
FIG. 11B is a Western blot demonstrating the efficacy and cumulative effect of repeat administration of compound AD-58641 in rats and depicts the amount of complement component C5 protein remaining in the serum of the animals.

Compound AD-58641 was further tested for efficacy and to evaluate the cumulative effect of the compound in rats using a repeat administration protocol. Wild-type Sprague Dawley rats were subcutaneously injected with compound AD-58641 at a 2.5 mg/kg/dose or 5.0 mg/kg/dose twice a week for 3 weeks (q2w×3). Serum was collected on days 0, 4, 7, 11, 14, 18, 25, and 32. Serum hemolytic activity was quantified using a hemolysis assay in which a 1:150 dilution of rat serum was incubated with sensitized sheep rat blood cells in GVB++ buffer for 1 hour and hemoglobin release was quantified by measuring absorbance at 415 nm (see FIG. 11A). The amount of C5 protein present in the samples was also determined by ELISA (FIG. 11B). The results demonstrate a dose dependent potent and durable decrease in hemolytic activity, achieving about 90% hemolytic activity inhibition.

TABLE 19

Additional Phosphorothioate Modifed GalNAC Conjugated C5 iRNAs

| Duplex ID | Sense strand | Sense sequence | SEQ ID NO:Antisense | Antisense sequence | SEQ ID NO: | Start position | Cross Reactivity | PS# |
|---|---|---|---|---|---|---|---|---|
| AD-58088.2 | A-118324.1 | AfuUfuAfaAfcAfAfCfaAfgUfaCfcCfuUfL96 | 559A-118325.1 | aAfaGfgUfaCfuUfguuGfuUfuAfaAfusCfsu | 580 | 984 | HumRheMus | 2 |
| AD-58644.1 | A-119328.1 | AfsusUfuAfaAfcAfaCfAfCfaAfgUfaCfcUfcUfuUfL96 | 560A-119329.1 | asAfsaGfgUfaCfuUfguuGfuUfuAfaAfuscsu | 581 | 984 | HumRheMus | 6 |
| AD-58651.1 | A-119328.2 | AfsusUfuAfaAfcAfaCfAfCfaAfgUfaCfcUfcUfuUfL96 | 561A-119339.1 | asAfsaGfsgUfsaCfsuUfsguuGfsuUfsu AfsaAfsuscsu | 582 | 984 | HumRheMus | 14 |
| AD-58099.2 | A-118312.1 | UfgAfcAfaAfaAfuAfAfAfcUfcAfcUfaUfaAfL96 | 562A-118313.1 | uUfaUfaGfuGfaGfuuaUfuUfuGfuCfasAfsu | 583 | 1513 | HumRheMusRat | 2 |
| AD-58641.1 | A-119322.1 | UfsgsAfcAfaAfaAfuUfAfAfcUfcAfcUfaUfaAfL96 | 563A-119323.1 | usUfsaUfaGfuGfaGfuuaUfuUfuGfuCfasasasu | 584 | 1513 | HumRheMusRat | 6 |
| AD-58648.1 | A-119322.2 | UfsgsAfcAfaAfaAfuUfAfAfcUfcAfcUfaUfaAfL96 | 564A-119336.1 | usUfsaUfsaGfsuGfsaGfsuuaUfsuUfsuGfsu Cfsasasu | 585 | 1513 | HumRheMusRat | 14 |
| AD-58111.2 | A-118316.1 | GfaCfaAfaAfuAfAfcAfcCfaCfuAfuAfaAfL96 | 565A-118317.1 | aUfaAfuAfgUfgAfguuAfuAfuUfuGfcsAfsa | 586 | 1514 | HumRheMusRat | 2 |
| AD-58642.1 | A-119324.1 | GfsasCfaAfaAfuAfAfcCfuCfaCfuAfuAfaAfL96 | 566A-119325.1 | asUfsuAfuAfgUfgAfguuAfuAfuUfgUfcsasa | 587 | 1514 | HumRheMusRat | 6 |
| AD-58649.1 | A-119324.2 | GfsasCfaAfaAfuAfAfcCfuCfaCfuAfuAfaAfL96 | 567A-119337.1 | asUfsuAfsuAfsgUfsgAfsguuAfsuUfsuUfsg Ufscsasa | 588 | 1514 | HumRheMusRat | 14 |
| AD-58116.2 | A-118396.1 | GfUfcCfgGfaUfaUfuUfgAfaCfuUfuUfL96 | 568A-118397.1 | aAfaAfgUfuCfaAfauaUfcCfgAfaCfsCfsg | 589 | 4502 | MusRat | 2 |
| AD-58647.1 | A-119334.1 | GfsusUfcCfgGfaUfaUfuUfgAfaCfuUfuUfL96 | 569A-119335.1 | asAfsaAfgUfuCfaAfauaUfcCfgGfaAfcscsg | 590 | 4502 | MusRat | 6 |
| AD-58654.1 | A-119334.2 | GfsusUfcCfgGfaUfaUfuUfgAfaCfuUfuUfL96 | 570A-119342.1 | asAfsaAfsgUfsuCfsaAfsauaUfscCfsgGfsa Afscscsg | 591 | 4502 | MusRat | 14 |

TABLE 19-continued

Additional Phosphorothioate Modifed GalNAC Conjugated C5 iRNAs

| Duplex ID | Sense strand | Sense sequence | SEQ ID NO:Antisense | Antisense sequence | SEQ ID NO: | Start position | Cross Reactivity | PS# |
|---|---|---|---|---|---|---|---|---|
| AD-58121.2 | A-118382.1 | UfgCfaGfaUfcAfAfAfcAfcAfaUfuUfcAfL96 | 571A-118383.1 | uGfaAfaUfuGfuGfuuuGfaUfcUfgCfasGfsa | 592 | 4945 | MusRat | 2 |
| AD-58645.1 | A-119330.1 | UfsgsCfaGfaUfcAfAfAfcAfcAfaUfuUfcAfL96 | 572A-119331.1 | usGfsaAfaUfuGfuGfuuuGfaUfcUfgCfasgsa | 593 | 4945 | MusRat | 6 |
| AD-58652.1 | A-119330.2 | UfsgsCfaGfaUfcAfAfAfcAfcAfaUfuUfcAfL96 | 573A-119340.1 | usGfsaAfsaUfsuGfsuGfsuuuGfsaUfscUfsg Cfsasgsa | 594 | 4945 | MusRat | 14 |
| AD-58123.2 | A-118320.1 | AfaGfcAfaGfaUfAfUfuUfaUfaAfuAfL96 | 574A-118321.1 | uAfuUfaUfaAfaAfauaUfcUfuGfcUfusUfsu | 595 | 786 | HumRheMus | 2 |
| AD-58643.1 | A-119326.1 | AfsasGfcAfaGfaUfAfUfuUfuUfaUfaAfuAfL96 | 575A-119327.1 | usAfsuUfaAfaAfauaUfcUfuGfcUfususu | 596 | 786 | HumRheMus | 6 |
| AD-58650.1 | A-119326.2 | AfsasGfcAfaGfaUfAfUfuUfuUfaUfaAfuAfL96 | 576A-119338.1 | usAfsuUfsaUfsaAfsaAfsauaUfscUfsuGfsc Ufsususu | 597 | 786 | HumRheMus | 14 |
| AD-58133.2 | A-118386.1 | CfaGfaUfcAfaAfCfAfcAfaUfuUfcAfgUfL96 | 577A-118387.1 | aCfuGfaAfaUfuGfuguUfuGfaUfcUfgsCfsa | 598 | 4947 | MusRat | 2 |
| AD-58646.1 | A-119332.1 | CfsasGfaUfcAfaAfCfAfcAfaUfuUfcAfgUfL96 | 578A-119333.1 | asCfsuGfaAfaUfuGfuguUfuGfaUfcUfgscsa | 599 | 4947 | MusRat | 6 |
| AD-58653.1 | A-119332.2 | CfsasGfaUfcAfaAfCfAfcAfaUfuUfcAfgUfL96 | 579A-119341.1 | asCfsuGfsaAfsaUfsuGfsuguUfsuGfsaUfsc Ufsgscsa | 600 | 4947 | MusRat | 14 |

Example 4

Design, Synthesis, and in Vitro Screening of Additional siRNAs siRNA Design

C5 duplexes, 19 nucleotides long for both the sense and antisense strand, were designed using the human C5 mRNA sequence set forth in GenBank Accession No. NM_001735.2. Five-hundred and sixty-nine duplexes were initially identified that did not contain repeats longer than 7 nucleotides, spanning substantially the entire 5480 nucleotide transcript. All 569 duplexes are then scored for predicted efficacy according to a linear model that evaluates the nucleotide pair at each duplex position, and the dose and cell line to be used for screening. The duplexes are also matched against all transcripts in the human RefSeq collection using a custom brute force algorithm, and scored for lowest numbers of mismatches (per strand) to transcripts other than C5. Duplexes to be synthesized and screened are then selected from the 569, according to the following scheme: Beginning at the 5' end of the transcript, a duplex is selected within a "window" of every 10±2 nucleotides that 1) had the highest predicted efficacy,
2) had at least one mismatch in both strands to all transcripts other than SERPINC1,
3) had not already been synthesized and screened as part of other duplex sets.

If no duplex is identified within a given window that satisfied all criteria, that window was skipped.

A detailed list of the 569 C5 sense and antisense strand sequences is shown in Table 20.

The in vitro efficacy of duplexes comprising the sense and antisense sequences listed in Table 20 is determined using the following methods.

Cell Culture and Transfections

HepG2 cells (ATCC, Manassas, Va.) are grown to near confluence at 37° C. in an atmosphere of 5% CO2 in Eagle's Minimum Essential Medium (ATCC) supplemented with 10% FBS, streptomycin, and glutamine (ATCC) before being released from the plate by trypsinization. Transfection is carried out by adding 14.8 µl of Opti-MEM plus 0.2 µl of Lipofectamine RNAiMax per well (Invitrogen, Carlsbad Calif. cat #13778-150) to 5 µl of each of the 164 siRNA duplexes to an individual well in a 96-well plate. The mixture is then incubated at room temperature for 15 minutes. 80 µl of complete growth media without antibiotic containing ~2.5×10$^4$ HepG2 cells is then added to the siRNA mixture. Cells are incubated for 24 hours prior to RNA purification. Experiments are performed at 20 nM and included naïve cells and cells transfected with AD-1955, a luciferase targeting siRNA as negative controls.

Total RNA Isolation Using DYNABEADS mRNA Isolation Kit (Invitrogen, Part #: 610-12)

Cells are harvested and lysed in 150 µl of Lysis/Binding Buffer then mixed for 5 minute at 700 rpm on a platform shaker (the mixing speed was the same throughout the process). Ten microliters of magnetic beads and 80 µl Lysis/Binding Buffer mixture are added to a round bottom plate and mixed for 1 minute. Magnetic beads are captured using magnetic stand and the supernatant is removed without disturbing the beads. After removing supernatant, the lysed cells are added to the remaining beads and mixed for 5 minutes. After removing supernatant, magnetic beads are washed 2 times with 150 µl Wash Buffer A and mixed for 1 minute. Beads are captured again and supernatant removed. Beads are then washed with 150 µl Wash Buffer B, captured and supernatant is removed. Beads are next washed with 150 µl Elution Buffer, captured and supernatant removed. Beads are allowed to dry for 2 minutes. After drying, 50 µl of Elution Buffer is added and mixed for 5 minutes at 70° C. Beads are captured on magnet for 5 minutes. Forty µl of supernatant, containing the isolated RNA is removed and added to another 96 well plate.

cDNA Synthesis Using ABI High Capacity cDNA Reverse Transcription Kit (Applied Biosystems, Foster City, Calif., Cat #4368813)

A master mix of 21 µl 10× Buffer, 0.8 µl 25×dNTPs, 2 µl Random primers, 1 µl Reverse Transcriptase, 1 µl RNase inhibitor and 3.2 µl of H2O per reaction is added into 10 µl total RNA. cDNA is generated using a Bio-Rad C-1000 or S-1000 thermal cycler (Hercules, Calif.) through the following steps: 25° C. 10 min, 37° C. 120 min, 85° C. 5 sec, 4° C. hold.

Real Time PCR

Two µl of cDNA is added to a master mix containing 0.5 µl human GAPDH TaqMan Probe (Applied Biosystems Cat #4326317E), 0.5 µl human SERPINC1 TaqMan probe (Applied Biosystems cat #Hs00892758_m1) and 5 µl Lightcycler 480 probe master mix (Roche Cat #04887301001) per well in a 384-well plate (Roche cat #04887301001). Real time PCR is performed in an LC480 Real Time PCR machine (Roche).

To calculate relative fold change, real time data is analyzed using the ΔΔCt method and normalized to assays performed with cells transfected with 20 nM AD-1955.

TABLE 20

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_3-21_s | 3-21 | UAUCCGUGGUUUCCUGCUA | 601 | UAGCAGGAAACCACGGAUA | 1170 |
| NM_001735.2_10-28_s | 10-28 | GGUUUCCUGCUACCUCCAA | 602 | UUGGAGGUAGCAGGAAACC | 1171 |
| NM_001735.2_22-40_s | 22-40 | CCUCCAACCAUGGGCCUUU | 603 | AAAGGCCCAUGGUUGGAGG | 1172 |
| NM_001735.2_33-51_s | 33-51 | GGGCCUUUUGGGAAUACUU | 604 | AAGUAUUCCCAAAAGGCCC | 1173 |
| NM_001735.2_43-61_s | 43-61 | GGAAUACUUUGUUUUUUAA | 605 | UUAAAAAACAAAGUAUUCC | 1174 |
| NM_001735.2_49-67_s | 49-67 | CUUUGUUUUUAAUCUUCC | 606 | GGAAGAUUAAAAAACAAAG | 1175 |
| NM_001735.2_63-81_s | 63-81 | CUUCCUGGGGAAAACCUGG | 607 | CCAGGUUUUCCCCAGGAAG | 1176 |
| NM_001735.2_71-89_s | 71-89 | GGAAAACCUGGGGACAGGA | 608 | UCCUGUCCCCAGGUUUUCC | 1177 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_81-99_s | 81-99 | GGGACAGGAGCAAACAUAU | 609 | AUAUGUUUGCUCCUGUCCC | 1178 |
| NM_001735.2_91-109_s | 91-109 | CAAACAUAUGUCAUUUCAG | 610 | CUGAAAUGACAUAUGUUUG | 1179 |
| NM_001735.2_102-120_s | 102-120 | CAUUUCAGCACCAAAAAUA | 611 | UAUUUUUGGUGCUGAAAUG | 1180 |
| NM_001735.2_109-127_s | 109-127 | GCACCAAAAAUAUUCCGUG | 612 | CACGGAAUAUUUUGGUGC | 1181 |
| NM_001735.2_123-141_s | 123-141 | CCGUGUUGGAGCAUCUGAA | 613 | UUCAGAUGCUCCAACACGG | 1182 |
| NM_001735.2_130-148_s | 130-148 | GGAGCAUCUGAAAAUAUUG | 614 | CAAUAUUUUCAGAUGCUCC | 1183 |
| NM_001735.2_139-157_s | 139157 | GAAAAUAUUGUGAUUCAAG | 615 | CUUGAAUCACAAUAUUUUC | 1184 |
| NM_001735.2_150-168_s | 150-168 | GAUUCAAGUUUAUGGAUAC | 616 | GUAUCCAUAAACUUGAAUC | 1185 |
| NM_001735.2_163-181_s | 163-181 | GGAUACACUGAAGCAUUUG | 617 | CAAAUGCUUCAGUGUAUCC | 1186 |
| NM_001735.2_172-190_s | 172-190 | GAAGCAUUUGAUGCAACAA | 618 | UUGUUGCAUCAAAUGCUUC | 1187 |
| NM_001735.2_183-201_s | 183-201 | UGCAACAAUCUCUAUUAAA | 619 | UUUAAUAGAGAUUGUUGCA | 1188 |
| NM_001735.2_189-207_s | 189-207 | AAUCUCUAUUAAAAGUUAU | 620 | AUAACUUUUAAUAGAGAUU | 1189 |
| NM_001735.2_201-219_s | 201-219 | AAGUUAUCCUGAUAAAAAA | 621 | UUUUUUAUCAGGAUAACUU | 1190 |
| NM_001735.2_209-227_s | 209-227 | CUGAUAAAAAAUUUAGUUA | 622 | UAACUAAAUUUUUUAUCAG | 1191 |
| NM_001735.2_221-239_s | 221-239 | UUAGUUACUCCUCAGGCCA | 623 | UGGCCUGAGGAGUAACUAA | 1192 |
| NM_001735.2_230-248_s | 230-248 | CCUCAGGCCAUGUUCAUUU | 624 | AAAUGAACAUGGCCUGAGG | 1193 |
| NM_001735.2_242-260_s | 242-260 | UUCAUUUAUCCUCAGAGAA | 625 | UUCUCUGAGGAUAAAUGAA | 1194 |
| NM_001735.2_252-270_s | 252-270 | CUCAGAGAAUAAAUUCCAA | 626 | UUGGAAUUUAUUCUCUGAG | 1195 |
| NM_001735.2_259-277_s | 259-277 | AAUAAAUUCCAAAACUCUG | 627 | CAGAGUUUUGGAAUUUAUU | 1196 |
| NM_001735.2_273-291_s | 273-291 | CUCUGCAAUCUUAACAAUA | 628 | UAUUGUUAAGAUUGCAGAG | 1197 |
| NM_001735.2_282-300_s | 282-300 | CUUAACAAUACAACCAAAA | 629 | UUUUGGUUGUAUUGUUAAG | 1198 |
| NM_001735.2_292-310_s | 292-310 | CAACCAAAACAAUUGCCUG | 630 | CAGGCAAUUGUUUUGGUUG | 1199 |
| NM_001735.2_301-319_s | 301-319 | CAAUUGCCUGGAGGACAAA | 631 | UUUGUCCUCCAGGCAAUUG | 1200 |
| NM_001735.2_313-331_s | 313-331 | GGACAAAACCCAGUUUCUU | 632 | AAGAAACUGGGUUUUGUCC | 1201 |
| NM_001735.2_322-340_s | 322-340 | CCAGUUUCUUAUGUGUAUU | 633 | AAUACACAUAAGAAACUGG | 1202 |
| NM_001735.2_332-350_s | 332-350 | AUGUGUAUUGGAAGUUGU | 634 | ACAACUUCCAAAUACACAU | 1203 |
| NM_001735.2_342-360_s | 342-360 | GGAAGUUGUAUCAAAGCAU | 635 | AUGCUUUGAUACAACUUCC | 1204 |
| NM_001735.2_349-367_s | 349-367 | GUAUCAAAGCAUUUUUCAA | 636 | UUGAAAAAUGCUUUGAUAC | 1205 |
| NM_001735.2_361-379_s | 361-379 | UUUUCAAAAUCAAAAGAA | 637 | UUCUUUUGAUUUUGAAAA | 1206 |
| NM_001735.2_371-389_s | 371-389 | CAAAAGAAUGCCAAUAAC | 638 | GUUAUUGGCAUUCUUUUG | 1207 |
| NM_001735.2_381-399_s | 381-399 | GCCAAUAACCUAUGACAAU | 639 | AUUGUCAUAGGUUAUUGGC | 1208 |
| NM_001735.2_389-407_s | 389-407 | CCUAUGACAAUGGAUUUCU | 640 | AGAAAUCCAUUGUCAUAGG | 1209 |
| NM_001735.2_399-417_s | 399-417 | UGGAUUUCUCUUCAUUCAU | 641 | AUGAAUGAAGAGAAAUCCA | 1210 |
| NM_001735.2_411-429_s | 411-429 | CAUUCAUACAGACAAACCU | 642 | AGGUUUGUCUGUAUGAAUG | 1211 |
| NM_001735.2_419-437_s | 419-437 | CAGACAAACCUGUUUAUAC | 643 | GUAUAAACAGGUUUGUCUG | 1212 |
| NM_001735.2_430-448_s | 430-448 | GUUUAUACUCCAGACCAGU | 644 | ACUGGUCUGGAGUAUAAAC | 1213 |
| NM_001735.2_441-459_s | 441-459 | AGACCAGUCAGUAAAAGUU | 645 | AACUUUUACUGACUGGUCU | 1214 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_450-468_s | 450-468 | AGUAAAAGUUAGAGUUUAU | 646 | AUAAACUCUAACUUUUACU | 1215 |
| NM_001735.2_460-478_s | 460-478 | AGAGUUUAUUCGUUGAAUG | 647 | CAUUCAACGAAUAAACUCU | 1216 |
| NM_001735.2_470-488_s | 470-488 | CGUUGAAUGACGACUUGAA | 648 | UUCAAGUCGUCAUUCAACG | 1217 |
| NM_001735.2_483-501_s | 483-501 | CUUGAAGCCAGCCAAAAGA | 649 | UCUUUUGGCUGGCUUCAAG | 1218 |
| NM_001735.2_490-508_s | 490-508 | CCAGCCAAAAGAGAAACUG | 650 | CAGUUUCUCUUUUGGCUGG | 1219 |
| NM_001735.2_503-521_s | 503-521 | AAACUGUCUUAACUUUCAU | 651 | AUGAAAGUUAAGACAGUUU | 1220 |
| NM_001735.2_513-531_s | 513-531 | AACUUUCAUAGAUCCUGAA | 652 | UUCAGGAUCUAUGAAAGUU | 1221 |
| NM_001735.2_519-537_s | 519-537 | CAUAGAUCCUGAAGGAUCA | 653 | UGAUCCUUCAGGAUCUAUG | 1222 |
| NM_001735.2_529-547_s | 529-547 | GAAGGAUCAGAAGUUGACA | 654 | UGUCAACUUCUGAUCCUUC | 1223 |
| NM_001735.2_543-561_s | 543-561 | UGACAUGGUAGAAGAAAUU | 655 | AAUUUCUUCUACCAUGUCA | 1224 |
| NM_001735.2_553-571_s | 553-571 | GAAGAAAUUGAUCAUAUUG | 656 | CAAUAUGAUCAAUUUCUUC | 1225 |
| NM_001735.2_562-580_s | 562-580 | GAUCAUAUUGGAAUUAUCU | 657 | AGAUAAUUCCAAUAUGAUC | 1226 |
| NM_001735.2_571-589_s | 571-589 | GGAAUUAUCUCUUUUCCUG | 658 | CAGGAAAAGAGAUAAUUCC | 1227 |
| NM_001735.2_579-597_s | 579-597 | CUCUUUUCCUGACUUCAAG | 659 | CUUGAAGUCAGGAAAAGAG | 1228 |
| NM_001735.2_590-608_s | 590-608 | ACUUCAAGAUUCCGUCUAA | 660 | UUAGACGGAAUCUUGAAGU | 1229 |
| NM_001735.2_601-619_s | 601-619 | CCGUCUAAUCCUAGAUAUG | 661 | CAUAUCUAGGAUUAGACGG | 1230 |
| NM_001735.2_610-628_s | 610-628 | CCUAGAUAUGGUAUGUGGA | 662 | UCCACAUACCAUAUCUAGG | 1231 |
| NM_001735.2_623-641_s | 623-641 | UGUGGACGAUCAAGGCUAA | 663 | UUAGCCUUGAUCGUCCACA | 1232 |
| NM_001735.2_629-647_s | 629-647 | CGAUCAAGGCUAAAUAUAA | 664 | UUAUAUUUAGCCUUGAUCG | 1233 |
| NM_001735.2_642-660_s | 642-660 | AUAUAAAGAGGACUUUUCA | 665 | UGAAAAGUCCUCUUUAUAU | 1234 |
| NM_001735.2_649-667_s | 649-667 | GAGGACUUUUCAACAACUG | 666 | CAGUUGUUGAAAAGUCCUC | 1235 |
| NM_001735.2_662-680_s | 662-680 | CAACUGGAACCGCAUAUUU | 667 | AAAUAUGCGGUUCCAGUUG | 1236 |
| NM_001735.2_672-690_s | 672-690 | CGCAUAUUUUGAAGUUAAA | 668 | UUUAACUUCAAAAUAUGCG | 1237 |
| NM_001735.2_683-701_s | 683-701 | AAGUUAAAGAAUAUGUCUU | 669 | AAGACAUAUUCUUUAACUU | 1238 |
| NM_001735.2_691-709_s | 691-709 | GAAUAUGUCUUGCCACAUU | 670 | AAUGUGGCAAGACAUAUUC | 1239 |
| NM_001735.2_703-721_s | 703-721 | CCACAUUUUUCUGUCUCAA | 671 | UUGAGACAGAAAAAUGUGG | 1240 |
| NM_001735.2_713-731_s | 713-731 | CUGUCUCAAUCGAGCCAGA | 672 | UCUGGCUCGAUUGAGACAG | 1241 |
| NM_001735.2_719-737_s | 719-737 | CAAUCGAGCCAGAAUAUAA | 673 | UUAUAUUCUGGCUCGAUUG | 1242 |
| NM_001735.2_730-748_s | 730-748 | GAAUAUAAUUUCAUUGGUU | 674 | AACCAAUGAAAUUAUAUUC | 1243 |
| NM_001735.2_742-760_s | 742-760 | AUUGGUUACAAGAACUUUA | 675 | UAAAGUUCUUGUAACCAAU | 1244 |
| NM_001735.2_752-770_s | 752-770 | AGAACUUUAAGAAUUUUGA | 676 | UCAAAAUUCUUAAAGUUCU | 1245 |
| NM_001735.2_762-780_s | 762-780 | GAAUUUUGAAAUUACUAUA | 677 | UAUAGUAAUUUCAAAAUUC | 1246 |
| NM_001735.2_769-787_s | 769-787 | GAAAUUACUAUAAAAGCAA | 678 | UUGCUUUUAUAGUAAUUUC | 1247 |
| NM_001735.2_781-799_s | 781-799 | AAAGCAAGAUAUUUUUAUA | 679 | UAUAAAAAUAUCUUGCUUU | 1248 |
| NM_001735.2_789-807_s | 789-807 | AUAUUUUUAUAAUAAAGUA | 680 | UACUUUAUUAUAAAAAUAU | 1249 |
| NM_001735.2_803-821_s | 803-821 | AAGUAGUCACUGAGGCUGA | 681 | UCAGCCUCAGUGACUACUU | 1250 |
| NM_001735.2_810-828_s | 810-828 | CACUGAGGCUGACGUUUAU | 682 | AUAAACGUCAGCCUCAGUG | 1251 |
| NM_001735.2_822-840_s | 822-840 | CGUUUAUAUCACAUUUGGA | 683 | UCCAAAUGUGAUAUAAACG | 1252 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_831-849_s | 831-849 | CACAUUUGGAAUAAGAGAA | 684 | UUCUCUUAUUCCAAAUGUG | 1253 |
| NM_001735.2_840-858_s | 840-858 | AAUAAGAGAAGACUUAAAA | 685 | UUUUAAGUCUUCUCUUAUU | 1254 |
| NM_001735.2_852-870_s | 852-870 | CUUAAAAGAUGAUCAAAAA | 686 | UUUUUGAUCAUCUUUUAAG | 1255 |
| NM_001735.2_859-877_s | 859-877 | GAUGAUCAAAAGAAAUGA | 687 | UCAUUUCUUUUGAUCAUC | 1256 |
| NM_001735.2_872-890_s | 872-890 | AAAUGAUGCAAACAGCAAU | 688 | AUUGCUGUUUGCAUCAUUU | 1257 |
| NM_001735.2_883-901_s | 883-901 | ACAGCAAUGCAAAACACAA | 689 | UUGUGUUUUGCAUUGCUGU | 1258 |
| NM_001735.2_893-911_s | 893-911 | AAAACACAAUGUUGAUAAA | 690 | UUUAUCAACAUUGUGUUUU | 1259 |
| NM_001735.2_899-917_s | 899-917 | CAAUGUUGAUAAAUGGAAU | 691 | AUUCCAUUUAUCAACAUUG | 1260 |
| NM_001735.2_913-931_s | 913-931 | GGAAUUGCUCAAGUCACAU | 692 | AUGUGACUUGAGCAAUUCC | 1261 |
| NM_001735.2_919-937_s | 919-937 | GCUCAAGUCACAUUUGAUU | 693 | AAUCAAAUGUGACUUGAGC | 1262 |
| NM_001735.2_930-948_s | 930-948 | AUUUGAUUCUGAAACAGCA | 694 | UGCUGUUUCAGAAUCAAAU | 1263 |
| NM_001735.2_939-957_s | 939-957 | UGAAACAGCAGUCAAAGAA | 695 | UUCUUUGACUGCUGUUUCA | 1264 |
| NM_001735.2_951-969_s | 951-969 | CAAAGAACUGUCAUACUAC | 696 | GUAGUAUGACAGUUCUUUG | 1265 |
| NM_001735.2_962-980_s | 962-980 | CAUACUACAGUUUAGAAGA | 697 | UCUUCUAAACUGUAGUAUG | 1266 |
| NM_001735.2_969-987_s | 969-987 | CAGUUUAGAAGAUUUAAAC | 698 | GUUUAAAUCUUCUAAACUG | 1267 |
| NM_001735.2_983-1001_s | 983-1001 | UAAACAACAAGUACCUUUA | 699 | UAAAGGUACUUGUUGUUUA | 1268 |
| NM_001735.2_990-1008_s | 990-1008 | CAAGUACCUUUAUAUUGCU | 700 | AGCAAUAUAAAGGUACUUG | 1269 |
| NM_001735.2_1002-1020_s | 1002-1020 | UAUUGCUGUAACAGUCAUA | 701 | UAUGACUGUUACAGCAAUA | 1270 |
| NM_001735.2_1011-1029_s | 1011-1029 | AACAGUCAUAGAGUCUACA | 702 | UGUAGACUCUAUGACUGUU | 1271 |
| NM_001735.2_1020-1038_s | 1020-1038 | AGAGUCUACAGGUGGAUUU | 703 | AAAUCCACCUGUAGACUCU | 1272 |
| NM_001735.2_1033-1051_s | 1033-1051 | GGAUUUUCUGAAGAGGCAG | 704 | CUGCCUCUUCAGAAAAUCC | 1273 |
| NM_001735.2_1042-1060_s | 1042-1060 | GAAGAGGCAGAAAUACCUG | 705 | CAGGUAUUUCUGCCUCUUC | 1274 |
| NM_001735.2_1050-1068_s | 1050-1068 | AGAAAUACCUGGCAUCAAA | 706 | UUUGAUGCCAGGUAUUUCU | 1275 |
| NM_001735.2_1061-1079_s | 1061-1079 | GCAUCAAAUAUGUCCUCUC | 707 | GAGAGGACAUAUUUGAUGC | 1276 |
| NM_001735.2_1071-1089_s | 1071-1089 | UGUCCUCUCUCCCUACAAA | 708 | UUUGUAGGGAGAGAGGACA | 1277 |
| NM_001735.2_1092-1110_s | 1092-1110 | GAAUUUGGUUGCUACUCCU | 709 | AGGAGUAGCAACCAAAUUC | 1278 |
| NM_001735.2_1102-1120_s | 1102-1120 | GCUACUCCUCUUUUCCUGA | 710 | UCAGGAAAAGAGGAGUAGC | 1279 |
| NM_001735.2_1109-1127_s | 1109-1127 | CUCUUUUCCUGAAGCCUGG | 711 | CCAGGCUUCAGGAAAAGAG | 1280 |
| NM_001735.2_1123-1141_s | 1123-1141 | CCUGGGAUUCCAUAUCCCA | 712 | UGGGAUAUGGAAUCCCAGG | 1281 |
| NM_001735.2_1133-1151_s | 1133-1151 | CAUAUCCCAUCAAGGUGCA | 713 | UGCACCUUGAUGGGAUAUG | 1282 |
| NM_001735.2_1139-1157_s | 1139-1157 | CCAUCAAGGUGCAGGUUAA | 714 | UUAACCUGCACCUUGAUGG | 1283 |
| NM_001735.2_1150-1168_s | 1150-1168 | CAGGUUAAAGAUUCGCUUG | 715 | CAAGCGAAUCUUUAACCUG | 1284 |
| NM_001735.2_1161-1179_s | 1161-1179 | UUCGCUUGACCAGUUGGUA | 716 | UACCAACUGGUCAAGCGAA | 1285 |
| NM_001735.2_1170-1188_s | 1170-1188 | CCAGUUGGUAGGAGGAGUC | 717 | GACUCCUCCUACCAACUGG | 1286 |
| NM_001735.2_1180-1198_s | 1180-1198 | GGAGGAGUCCCAGUAACAC | 718 | GUGUUACUGGGACUCCUCC | 1287 |
| NM_001735.2_1190-1208_s | 1190-1208 | CAGUAACACUGAAUGCACA | 719 | UGUGCAUUCAGUGUUACUG | 1288 |
| NM_001735.2_1200-1218_s | 1200-1218 | GAAUGCACAAACAAUUGAU | 720 | AUCAAUUGUUUGUGCAUUC | 1289 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_1209-1227_s | 1209-1227 | AACAAUUGAUGUAAACCAA | 721 | UUGGUUUACAUCAAUUGUU | 1290 |
| NM_001735.2_1220-1238_s | 1220-1238 | UAAACCAAGAGACAUCUGA | 722 | UCAGAUGUCUCUUGGUUUA | 1291 |
| NM_001735.2_1232-1250_s | 1232-1250 | CAUCUGACUUGGAUCCAAG | 723 | CUUGGAUCCAAGUCAGAUG | 1292 |
| NM_001735.2_1243-1261_s | 1243-1261 | GAUCCAAGCAAAAGUGUAA | 724 | UUACACUUUUGCUUGGAUC | 1293 |
| NM_001735.2_1251-1269_s | 1251-1269 | CAAAAGUGUAACACGUGUU | 725 | AACACGUGUUACACUUUUG | 1294 |
| NM_001735.2_1260-1278_s | 1260-1278 | AACACGUGUUGAUGAUGGA | 726 | UCCAUCAUCAACACGUGUU | 1295 |
| NM_001735.2_1272-1290_s | 1272-1290 | UGAUGGAGUAGCUUCCUUU | 727 | AAAGGAAGCUACUCCAUCA | 1296 |
| NM_001735.2_1279-1297_s | 1279-1297 | GUAGCUUCCUUUGUGCUUA | 728 | UAAGCACAAAGGAAGCUAC | 1297 |
| NM_001735.2_1293-1311_s | 1293-1311 | GCUUAAUCUCCCAUCUGGA | 729 | UCCAGAUGGGAGAUUAAGC | 1298 |
| NM_001735.2_1303-1321_s | 1303-1321 | CCAUCUGGAGUGACGGUGC | 730 | GCACCGUCACUCCAGAUGG | 1299 |
| NM_001735.2_1313-1331_s | 1313-1331 | UGACGGUGCUGGAGUUUAA | 731 | UUAAACUCCAGCACCGUCA | 1300 |
| NM_001735.2_1320-1338_s | 1320-1338 | GCUGGAGUUUAAUGUCAAA | 732 | UUUGACAUUAAACUCCAGC | 1301 |
| NM_001735.2_1332-1350_s | 1332-1350 | UGUCAAAACUGAUGCUCCA | 733 | UGGAGCAUCAGUUUUGACA | 1302 |
| NM_001735.2_1342-1360_s | 1342-1360 | GAUGCUCCAGAUCUUCCAG | 734 | CUGGAAGAUCUGGAGCAUC | 1303 |
| NM_001735.2_1349-1367_s | 1349-1367 | CAGAUCUUCCAGAAGAAAA | 735 | UUUUCUUCUGGAAGAUCUG | 1304 |
| NM_001735.2_1362-1380_s | 1362-1380 | AGAAAAUCAGGCCAGGGAA | 736 | UUCCCUGGCCUGAUUUUCU | 1305 |
| NM_001735.2_1371-1389_s | 1371-1389 | GGCCAGGGAAGGUUACCGA | 737 | UCGGUAACCUUCCCUGGCC | 1306 |
| NM_001735.2_1382-1400_s | 1382-1400 | GUUACCGAGCAAUAGCAUA | 738 | UAUGCUAUUGCUCGGUAAC | 1307 |
| NM_001735.2_1393-1411_s | 1393-1411 | AUAGCAUACUCAUCUCUCA | 739 | UGAGAGAUGAGUAUGCUAU | 1308 |
| NM_001735.2_1399-1417_s | 1399-1471 | UACUCAUCUCUCAGCCAAA | 740 | UUUGGCUGAGAGAUGAGUA | 1309 |
| NM_001735.2_1412-1430_s | 1412-1430 | GCCAAAGUUACCUUUAUAU | 741 | AUAUAAAGGUAACUUUGGC | 1310 |
| NM_001735.2_1422-1440_s | 1422-1440 | CCUUUAUAUUGAUUGGACU | 742 | AGUCCAAUCAAUAUAAAGG | 1311 |
| NM_001735.2_1432-1450_s | 1432-1450 | GAUUGGACUGAUAACCAUA | 743 | UAUGGUUAUCAGUCCAAUC | 1312 |
| NM_001735.2_1439-1457_s | 1439-1457 | CUGAUAACCAUAAGGCUUU | 744 | AAAGCCUUAUGGUUAUCAG | 1313 |
| NM_001735.2_1451-1469_s | 1451-1469 | AGGCUUUGCUAGUGGGAGA | 745 | UCUCCCACUAGCAAAGCCU | 1314 |
| NM_001735.2_1462-1480_s | 1462-1480 | GUGGGAGAACAUCUGAAUA | 746 | UAUUCAGAUGUUCUCCCAC | 1315 |
| NM_001735.2_1471-1489_s | 1471-1489 | CAUCUGAAUAUUAUUGUUA | 747 | UAACAAUAAUAUUCAGAUG | 1316 |
| NM_001735.2_1479-1497_s | 1479-1497 | UAUUAUUGUUACCCCCAAA | 748 | UUUGGGGUAACAAUAAUA | 1317 |
| NM_001735.2_1492-1510_s | 1492-1510 | CCCAAAAGCCCAUAUAUUG | 749 | CAAUAUAUGGGCUUUUGGG | 1318 |
| NM_001735.2_1493-1511_s | 1493-1511 | CCAAAAGCCCAUAUAUUGA | 750 | UCAAUAUAUGGGCUUUUGG | 1319 |
| NM_001735.2_1494-1512_s | 1494-1512 | CAAAAGCCCAUAUAUUGAC | 751 | GUCAAUAUAUGGGCUUUUG | 1320 |
| NM_001735.2_1495-1513_s | 1495-1513 | AAAAGCCCAUAUAUUGACA | 752 | UGUCAAUAUAUGGGCUUUU | 1321 |
| NM_001735.2_1496-1514_s | 1496-1514 | AAAGCCCAUAUAUUGACAA | 753 | UUGUCAAUAUAUGGGCUUU | 1322 |
| NM_001735.2_1497-1515_s | 1497-1515 | AAGCCCAUAUAUUGACAAA | 754 | UUUGUCAAUAUAUGGGCUU | 1323 |
| NM_001735.2_1498-1516_s | 1498-1516 | AGCCCAUAUAUUGACAAAA | 755 | UUUUGUCAAUAUAUGGGCU | 1324 |
| NM_001735.2_1499-1517_s | 1499-1517 | GCCCAUAUAUUGACAAAAU | 756 | AUUUUGUCAAUAUAUGGGC | 1325 |
| NM_001735.2_1500-1518_s | 1500-1518 | CCCAUAUAUUGACAAAAUA | 757 | UAUUUUGUCAAUAUAUGGG | 1326 |
| NM_001735.2_1501-1519_s | 1501-1519 | CCAUAUAUUGACAAAAUAA | 758 | UUAUUUUGUCAAUAUAUGG | 1327 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
| --- | --- | --- | --- | --- | --- |
| NM_001735.2_1502-1520_s | 1502-1520 | CAUAUAUUGACAAAAUAAC | 759 | GUUAUUUUGUCAAUAUAUG | 1328 |
| NM_001735.2_1503-1521_s | 1503-1521 | AUAUAUUGACAAAAUAACU | 760 | AGUUAUUUUGUCAAUAUAU | 1329 |
| NM_001735.2_1504-1522_s | 1504-1522 | UAUAUUGACAAAAUAACUC | 761 | GAGUUAUUUUGUCAAUAUA | 1330 |
| NM_001735.2_1505-1523_s | 1505-1523 | AUAUUGACAAAAUAACUCA | 762 | UGAGUUAUUUUGUCAAUAU | 1331 |
| NM_001735.2_1506-1524_s | 1506-1524 | UAUUGACAAAAUAACUCAC | 763 | GUGAGUUAUUUUGUCAAUA | 1332 |
| NM_001735.2_1507-1525_s | 1507-1525 | AUUGACAAAAUAACUCACU | 764 | AGUGAGUUAUUUUGUCAAU | 1333 |
| NM_001735.2_1508-1526_s | 1508-1526 | UUGACAAAAUAACUCACUA | 765 | UAGUGAGUUAUUUUGUCAA | 1334 |
| NM_001735.2_1509-1527_s | 1509-1527 | UGACAAAAUAACUCACUAU | 766 | AUAGUGAGUUAUUUUGUCA | 1335 |
| NM_001735.2_1510-1528_s | 1510-1528 | GACAAAAUAACUCACUAUA | 767 | UAUAGUGAGUUAUUUUGUC | 1336 |
| NM_001735.2_1513-1531_s | 1513-1531 | AAAAUAACUCACUAUAAUU | 768 | AAUUAUAGUGAGUUAUUUU | 1337 |
| NM_001735.2_1514-1532_s | 1514-1532 | AAAUAACUCACUAUAAUUA | 769 | UAAUUAUAGUGAGUUAUUU | 1338 |
| NM_001735.2_1515-1533_s | 1515-1533 | AAUAACUCACUAUAAUUAC | 770 | GUAAUUAUAGUGAGUUAUU | 1339 |
| NM_001735.2_1516-1534_s | 1516-1534 | AUAACUCACUAUAAUUACU | 771 | AGUAAUUAUAGUGAGUUAU | 1340 |
| NM_001735.2_1518-1536_s | 1518-1536 | AACUCACUAUAAUUACUUG | 772 | CAAGUAAUUAUAGUGAGUU | 1341 |
| NM_001735.2_1519-1537_s | 1519-1537 | ACUCACUAUAAUUACUUGA | 773 | UCAAGUAAUUAUAGUGAGU | 1342 |
| NM_001735.2_1520-1538_s | 1520-1538 | CUCACUAUAAUUACUUGAU | 774 | AUCAAGUAAUUAUAGUGAG | 1343 |
| NM_001735.2_1521-1539_s | 1521-1539 | UCACUAUAAUUACUUGAUU | 775 | AAUCAAGUAAUUAUAGUGA | 1344 |
| NM_001735.2_1523-1541_s | 1523-1541 | ACUAUAAUUACUUGAUUUU | 776 | AAAAUCAAGUAAUUAUAGU | 1345 |
| NM_001735.2_1524-1542_s | 1524-1542 | CUAUAAUUACUUGAUUUUA | 777 | UAAAAUCAAGUAAUUAUAG | 1346 |
| NM_001735.2_1525-1543_s | 1525-1543 | UAUAAUUACUUGAUUUUAU | 778 | AUAAAAUCAAGUAAUUAUA | 1347 |
| NM_001735.2_1526-1544_s | 1526-1544 | AUAAUUACUUGAUUUUAUC | 779 | GAUAAAAUCAAGUAAUUAU | 1348 |
| NM_001735.2_1527-1545_s | 1527-1545 | UAAUUACUUGAUUUUAUCC | 780 | GGAUAAAAUCAAGUAAUUA | 1349 |
| NM_001735.2_1528-1546_s | 1528-1546 | AAUUACUUGAUUUUAUCCA | 781 | UGGAUAAAAUCAAGUAAUU | 1350 |
| NM_001735.2_1529-1547_s | 1529-1547 | AUUACUUGAUUUUAUCCAA | 782 | UUGGAUAAAAUCAAGUAAU | 1351 |
| NM_001735.2_1540-1558_s | 1540-1558 | UUAUCCAAGGGCAAAAUUA | 783 | UAAUUUUGCCCUUGGAUAA | 1352 |
| NM_001735.2_1550-1568_s | 1550-1568 | GCAAAAUUAUCCACUUUGG | 784 | CCAAAGUGGAUAAUUUUGC | 1353 |
| NM_001735.2_1561-1579_s | 1561-1579 | CACUUUGGCACGAGGGAGA | 785 | UCUCCCUCGUGCCAAAGUG | 1354 |
| NM_001735.2_1571-1589_s | 1571-1589 | CGAGGGAGAAAUUUUCAGA | 786 | UCUGAAAAUUUCUCCCUCG | 1355 |
| NM_001735.2_1581-1599_s | 1581-1599 | AUUUUCAGAUGCAUCUUAU | 787 | AUAAGAUGCAUCUGAAAAU | 1356 |
| NM_001735.2_1591-1609_s | 1591-1609 | GCAUCUUAUCAAAGUAUAA | 788 | UUAUACUUUGAUAAGAUGC | 1357 |
| NM_001735.2_1600-1618_s | 1600-1618 | CAAAGUAUAAACAUUCCAG | 789 | CUGGAAUGUUUAUACUUUG | 1358 |
| NM_001735.2_1612-1630_s | 1612-1630 | AUUCCAGUAACACAGAACA | 790 | UGUUCUGUGUUACUGGAAU | 1359 |
| NM_001735.2_1622-1640_s | 1622-1640 | CACAGAACAUGGUUCCUUC | 791 | GAAGGAACCAUGUUCUGUG | 1360 |
| NM_001735.2_1632-1650_s | 1632-1560 | GGUUCCUUCAUCCCGACUU | 792 | AAGUCGGGAUGAAGGAACC | 1361 |
| NM_001735.2_1643-1661_s | 1643-1661 | CCCGACUUCUGGUCUAUUA | 793 | UAAUAGACCAGAAGUCGGG | 1362 |
| NM_001735.2_1653-1671_s | 1653-1671 | GGUCUAUUACAUCGUCACA | 794 | UGUGACGAUGUAAUAGACC | 1363 |
| NM_001735.2_1663-1681_s | 1663-1681 | AUCGUCACAGGAGAACAGA | 795 | UCUGUUCUCCUGUGACGAU | 1364 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_1670-1688_s | 1670-1688 | CAGGAGAACAGACAGCAGA | 796 | UCUGCUGUCUGUUCUCCUG | 1365 |
| NM_001735.2_1682-1700_s | 1682-1700 | CAGCAGAAUUAGUGUCUGA | 797 | UCAGACACUAAUUCUGCUG | 1366 |
| NM_001735.2_1693-1711_s | 1693-1711 | GUGUCUGAUUCAGUCUGGU | 798 | ACCAGACUGAAUCAGACAC | 1367 |
| NM_001735.2_1703-1721_s | 1703-1721 | CAGUCUGGUUAAAUAUUGA | 799 | UCAAUAUUUAACCAGACUG | 1368 |
| NM_001735.2_1710-1728_s | 1710-1728 | GUUAAAUAUUGAAGAAAAA | 800 | UUUUUCUUCAAUAUUUAAC | 1369 |
| NM_001735.2_1722-1740_s | 1722-1740 | AGAAAAAUGUGGCAACCAG | 801 | CUGGUUGCCACAUUUUUCU | 1370 |
| NM_001735.2_1733-1751_s | 1733-1751 | GCAACCAGCUCCAGGUUCA | 802 | UGAACCUGGAGCUGGUUGC | 1371 |
| NM_001735.2_1740-1758_s | 1740-1758 | GCUCCAGGUUCAUCUGUCU | 803 | AGACAGAUGAACCUGGAGC | 1372 |
| NM_001735.2_1751-1769_s | 1751-1769 | AUCUGUCUCCUGAUGCAGA | 804 | UCUGCAUCAGGAGACAGAU | 1373 |
| NM_001735.2_1762-1780_s | 1762-1780 | GAUGCAGAUGCAUAUUCUC | 805 | GAGAAUAUGCAUCUGCAUC | 1374 |
| NM_001735.2_1771-1789_s | 1771-1789 | GCAUAUUCUCCAGGCCAAA | 806 | UUUGGCCUGGAGAAUAUGC | 1375 |
| NM_001735.2_1782-1800_s | 1782-1800 | AGGCCAAACUGUGUCUCUU | 807 | AAGAGACACAGUUUGGCCU | 1376 |
| NM_001735.2_1792-1810_s | 1792-1810 | GUGUCUCUUAAUAUGGCAA | 808 | UUGCCAUAUUAAGAGACAC | 1377 |
| NM_001735.2_1799-1817_s | 1799-1817 | UUAAUAUGGCAACUGGAAU | 809 | AUUCCAGUUGCCAUAUUAA | 1378 |
| NM_001735.2_1809-1827_s | 1809-1827 | AACUGGAAUGGAUUCCUGG | 810 | CCAGGAAUCCAUUCCAGUU | 1379 |
| NM_001735.2_1821-1839_s | 1821-1839 | UUCCUGGGUGGCAUUAGCA | 811 | UGCUAAUGCCACCCAGGAA | 1380 |
| NM_001735.2_1830-1848_s | 1830-1848 | GGCAUUAGCAGCAGUGGAC | 812 | GUCCACUGCUGCUAAUGCC | 1381 |
| NM_001735.2_1842-1860_s | 1842-1860 | AGUGGACAGUGCUGUGUAU | 813 | AUACACAGCACUGUCCACU | 1382 |
| NM_001735.2_1852-1870_s | 1852-1870 | GCUGUGUAUGGAGUCCAAA | 814 | UUUGGACUCCAUACACAGC | 1383 |
| NM_001735.2_1863-1881_s | 1863-1881 | AGUCCAAAGAGGAGCCAAA | 815 | UUUGGCUCCUCUUUGGACU | 1384 |
| NM_001735.2_1870-1888_s | 1870-1888 | AGAGGAGCCAAAAGCCCU | 816 | AGGGCUUUUGGCUCCUCU | 1385 |
| NM_001735.2_1883-1901_s | 1883-1901 | AGCCCUUGGAAAGAGUAUU | 817 | AAUACUCUUUCCAAGGGCU | 1386 |
| NM_001735.2_1893-1911_s | 1893-1911 | AAGAGUAUUUCAAUUCUUA | 818 | UAAGAAUUGAAAUACUCUU | 1387 |
| NM_001735.2_1900-1918_s | 1900-1918 | UUUCAAUUCUUAGAGAAGA | 819 | UCUUCUCUAAGAAUUGAAA | 1388 |
| NM_001735.2_1912-1930_s | 1912-1930 | GAGAAGAGUGAUCUGGGCU | 820 | AGCCCAGAUCACUCUUCUC | 1389 |
| NM_001735.2_1920-1938_s | 1920-1938 | UGAUCUGGGCUGUGGGGCA | 821 | UGCCCCACAGCCCAGAUCA | 1390 |
| NM_001735.2_1933-1951_s | 1933-1951 | GGGGCAGGUGGUGGCCUCA | 822 | UGAGGCCACCACCUGCCCC | 1391 |
| NM_001735.2_1943-1961_s | 1943-1961 | GUGGCCUCAACAAUGCCAA | 823 | UUGGCAUUGUUGAGGCCAC | 1392 |
| NM_001735.2_1950-1968_s | 1950-1968 | CAACAAUGCCAAUGUGUUC | 824 | GAACACAUUGGCAUUGUUG | 1393 |
| NM_001735.2_1959-1977_s | 1959-1977 | CAAUGUGUUCCACCUAGCU | 825 | AGCUAGGUGGAACACAUUG | 1394 |
| NM_001735.2_1969-1987_s | 1969-1987 | CACCUAGCUGGACUUACCU | 826 | AGGUAAGUCCAGCUAGGUG | 1395 |
| NM_001735.2_1979-1997_s | 1979-1997 | GACUUACCUUCCUCACUAA | 827 | UUAGUGAGGAAGGUAAGUC | 1396 |
| NM_001735.2_1991-2009_s | 1991-2009 | UCACUAAUGCAAAUGCAGA | 828 | UCUGCAUUUGCAUUAGUGA | 1397 |
| NM_001735.2_2001-2019_s | 2001-2019 | AAAUGCAGAUGACUCCCAA | 829 | UUGGGAGUCAUCUGCAUUU | 1398 |
| NM_001735.2_2013-2031_s | 2013-2013 | CUCCCAAGAAAAUGAUGAA | 830 | UUCAUCAUUUUCUUGGGAG | 1399 |
| NM_001735.2_2032-2050_s | 2032-2050 | CCUUGUAAAGAAAUUCUCA | 831 | UGAGAAUUUCUUUACAAGG | 1400 |
| NM_001735.2_2043-2061_s | 2043-2061 | AAUUCUCAGGCCAAGAAGA | 832 | UCUUCUUGGCCUGAGAAUU | 1401 |
| NM_001735.2_2053-2071_s | 2053-2071 | CCAAGAAGAACGCUGCAAA | 833 | UUUGCAGCGUUCUUCUUGG | 1402 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_2063-2081_s | 2063-2081 | CGCUGCAAAAGAAGAUAGA | 834 | UCUAUCUUCUUUUGCAGCG | 1403 |
| NM_001735.2_2070-2088_s | 2070-2088 | AAAGAAGAUAGAAGAAAUA | 835 | UAUUUCUUCUAUCUUCUUU | 1404 |
| NM_001735.2_2082-2100_s | 2082-2100 | AGAAAUAGCUGCUAAAUAU | 836 | AUAUUUAGCAGCUAUUUCU | 1405 |
| NM_001735.2_2089-2107_s | 2089-2107 | GCUGCUAAAUAUAAACAUU | 837 | AAUGUUUAUAUUUAGCAGC | 1406 |
| NM_001735.2_2103-2121_s | 2103-2121 | ACAUUCAGUAGUGAAGAAA | 838 | UUUCUUCACUACUGAAUGU | 1407 |
| NM_001735.2_2110-2128_s | 2110-2128 | GUAGUGAAGAAAUGUUGUU | 839 | AACAACAUUUCUUCACUAC | 1408 |
| NM_001735.2_2119-2137_s | 2119-2137 | AAAUGUUGUUACGAUGGAG | 840 | CUCCAUCGUAACAACAUUU | 1409 |
| NM_001735.2_2130-2148_s | 2130-2148 | CGAUGGAGCCUGCGUUAAU | 841 | AUUAACGCAGGCUCCAUCG | 1410 |
| NM_001735.2_2142-2160_s | 2142-2160 | CGUUAAUAAUGAUGAAACC | 842 | GGUUUCAUCAUUAUUAACG | 1411 |
| NM_001735.2_2150-2168_s | 2150-2168 | AUGAUGAAACCUGUGAGCA | 843 | UGCUCACAGGUUUCAUCAU | 1412 |
| NM_001735.2_2160-2178_s | 2160-2178 | CUGUGAGCAGCGAGCUGCA | 844 | UGCAGCUCGCUGCUCACAG | 1413 |
| NM_001735.2_2170-2188_s | 2170-2188 | CGAGCUGCACGGAUUAGUU | 845 | AACUAAUCCGUGCAGCUCG | 1414 |
| NM_001735.2_2180-2198_s | 2180-2198 | GGAUUAGUUUAGGGCCAAG | 846 | CUUGGCCCUAAACUAAUCC | 1415 |
| NM_001735.2_2191-2209_s | 2191-2209 | GGGCCAAGAUGCAUCAAAG | 847 | CUUUGAUGCAUCUUGGCCC | 1416 |
| NM_001735.2_2202-2220_s | 2202-2220 | CAUCAAAGCUUUCACUGAA | 848 | UUCAGUGAAAGCUUUGAUG | 1417 |
| NM_001735.2_2209-2227_s | 2209-2227 | GCUUUCACUGAAUGUUGUG | 849 | CACAACAUUCAGUGAAAGC | 1418 |
| NM_001735.2_2219-2237_s | 2219-2237 | AAUGUUGUGUCGUCGCAAG | 850 | CUUGCGACGACACAACAUU | 1419 |
| NM_001735.2_2229-2247_s | 2229-2247 | CGUCGCAAGCCAGCUCCGU | 851 | ACGGAGCUGGCUUGCGACG | 1420 |
| NM_001735.2_2241-2259_s | 2241-2259 | GCUCCGUGCUAAUAUCUCU | 852 | AGAGAUAUUAGCACGGAGC | 1421 |
| NM_001735.2_2249-2267_s | 2249-2267 | CUAAUAUCUCUCAUAAAGA | 853 | UCUUUAUGAGAGAUAUUAG | 1422 |
| NM_001735.2_2263-2281_s | 2263-2281 | AAAGACAUGCAAUUGGGAA | 854 | UUCCCAAUUGCAUGUCUUU | 1423 |
| NM_001735.2_2272-2290_s | 2272-2290 | CAAUUGGGAAGGCUACACA | 855 | UGUGUAGCCUUCCCAAUUG | 1424 |
| NM_001735.2_2283-2301_s | 2283-2301 | GCUACACAUGAAGACCCUG | 856 | CAGGGUCUUCAUGUGUAGC | 1425 |
| NM_001735.2_2289-2307_s | 2289-2307 | CAUGAAGACCCUGUUACCA | 857 | UGGUAACAGGGUCUUCAUG | 1426 |
| NM_001735.2_2303-2321_s | 2303-2321 | UACCAGUAAGCAAGCCAGA | 858 | UCUGGCUUGCUUACUGGUA | 1427 |
| NM_001735.2_2311-2329_s | 2311-2329 | AGCAAGCCAGAAAUUCGGA | 859 | UCCGAAUUUCUGGCUUGCU | 1428 |
| NM_001735.2_2319-2337_s | 2319-2337 | AGAAAUUCGGAGUUAUUUU | 860 | AAAAUAACUCCGAAUUUCU | 1429 |
| NM_001735.2_2329-2347_s | 2329-2347 | AGUUAUUUUCCAGAAAGCU | 861 | AGCUUUCUGGAAAAUAACU | 1430 |
| NM_001735.2_2339-2357_s | 2339-2357 | CAGAAAGCUGGUUGUGGGA | 862 | UCCCACAACCAGCUUUCUG | 1431 |
| NM_001735.2_2352-2370_s | 2352-2370 | GUGGGAAGUUCAUCUUGUU | 863 | AACAAGAUGAACUUCCCAC | 1432 |
| NM_001735.2_2361-2379_s | 2361-2379 | UCAUCUUGUUCCCAGAAGA | 864 | UCUUCUGGGAACAAGAUGA | 1433 |
| NM_001735.2_2372-2390_s | 2372-2390 | CCAGAAGAAAACAGUUGCA | 865 | UGCAACUGUUUUCUUCUGG | 1434 |
| NM_001735.2_2383-2401_s | 2383-2401 | CAGUUGCAGUUUGCCCUAC | 866 | GUAGGGCAAACUGCAACUG | 1435 |
| NM_001735.2_2389-2407_s | 2389-2407 | CAGUUUGCCCUACCUGAUU | 867 | AAUCAGGUAGGGCAAACUG | 1436 |
| NM_001735.2_2401-2419_s | 2401-2419 | CCUGAUUCUCUAACCACCU | 868 | AGGUGGUUAGAGAAUCAGG | 1437 |
| NM_001735.2_2413-2431_s | 2413-2431 | ACCACCUGGGAAAUUCAAG | 869 | CUUGAAUUUCCCAGGUGGU | 1438 |
| NM_001735.2_2422-2440_s | 2422-2440 | GAAAUUCAAGGCGUUGGCA | 870 | UGCCAACGCCUUGAAUUUC | 1439 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_2433-2451_s | 2433-2451 | CGUUGGCAUUUCAAACACU | 871 | AGUGUUUGAAAUGCCAACG | 1440 |
| NM_001735.2_2439-2457_s | 2439-2457 | CAUUUCAAACACUGGUAUA | 872 | UAUACCAGUGUUUGAAAUG | 1441 |
| NM_001735.2_2453-2471_s | 2453-2471 | GUAUAUGUGUUGCUGAUAC | 873 | GUAUCAGCAACACAUAUAC | 1442 |
| NM_001735.2_2463-2481_s | 2463-2481 | UGCUGAUACUGUCAAGGCA | 874 | UGCCUUGACAGUAUCAGCA | 1443 |
| NM_001735.2_2471-2489_s | 2471-2489 | CUGUCAAGGCAAAGGUGUU | 875 | AACACCUUUGCCUUGACAG | 1444 |
| NM_001735.2_2483-2501_s | 2483-2501 | AGGUGUUCAAAGAUGUCUU | 876 | AAGACAUCUUUGAACACCU | 1445 |
| NM_001735.2_2490-2508_s | 2490-2508 | CAAAGAUGUCUUCCUGGAA | 877 | UUCCAGGAAGACAUCUUUG | 1446 |
| NM_001735.2_2499-2517_s | 2499-2517 | CUUCCUGGAAAUGAAUAUA | 878 | UAUAUUCAUUUCCAGGAAG | 1447 |
| NM_001735.2_2511-2529_s | 2511-2529 | GAAUAUACCAUAUUCUGUU | 879 | AACAGAAUAUGGUAUAUUC | 1448 |
| NM_001735.2_2520-2538_s | 2520-2538 | AUAUUCUGUUGUACGAGGA | 880 | UCCUCGUACAACAGAAUAU | 1449 |
| NM_001735.2_2533-2551_s | 2533-2551 | CGAGGAGAACAGAUCCAAU | 881 | AUUGGAUCUGUUCUCCUCG | 1450 |
| NM_001735.2_2539-2557_s | 2539-2557 | GAACAGAUCCAAUUGAAAG | 882 | CUUUCAAUUGGAUCUGUUC | 1451 |
| NM_001735.2_2553-2571_s | 2553-2571 | GAAAGGAACUGUUUACAAC | 883 | GUUGUAAACAGUUCCUUUC | 1452 |
| NM_001735.2_2560-2578_s | 2560-2578 | ACUGUUUACAACUAUAGGA | 884 | UCCUAUAGUUGUAAACAGU | 1453 |
| NM_001735.2_2569-2587_s | 2569-2587 | AACUAUAGGACUUCUGGGA | 885 | UCCCAGAAGUCCUAUAGUU | 1454 |
| NM_001735.2_2583-2601_s | 2583-2601 | UGGGAUGCAGUUCUGUGUU | 886 | AACACAGAACUGCAUCCCA | 1455 |
| NM_001735.2_2592-2610_s | 2592-2610 | GUUCUGUGUUAAAAUGUCU | 887 | AGACAUUUUAACACAGAAC | 1456 |
| NM_001735.2_2600-2618_s | 2600-2618 | UUAAAAUGUCUGCUGUGGA | 888 | UCCACAGCAGACAUUUUAA | 1457 |
| NM_001735.2_2612-2630_s | 2612-2630 | CUGUGGAGGGAAUCUGCAC | 889 | GUGCAGAUUCCCUCCACAG | 1458 |
| NM_001735.2_2620-2638_s | 2620-2638 | GGAAUCUGCACUUCCGGAAA | 890 | UUUCCGAAGUGCAGAUUCC | 1459 |
| NM_001735.2_2633-2651_s | 2633-2651 | CGGAAAGCCCAGUCAUUGA | 891 | UCAAUGACUGGGCUUUCCG | 1460 |
| NM_001735.2_2641-2659_s | 2641-2659 | CCAGUCAUUGAUCAUCAGG | 892 | CCUGAUGAUCAAUGACUGG | 1461 |
| NM_001735.2_2653-2671_s | 2653-2671 | CAUCAGGGCACAAAGUCCU | 893 | AGGACUUUGUGCCCUGAUG | 1462 |
| NM_001735.2_2659-2677_s | 2659-2677 | GGCACAAAGUCCUCCAAAU | 894 | AUUUGGAGGACUUUGUGCC | 1463 |
| NM_001735.2_2673-2691_s | 2673-2691 | CAAAUGUGUGCGCCAGAAA | 895 | UUUCUGGCGCACACAUUUG | 1464 |
| NM_001735.2_2682-2700_s | 2682-2700 | GCGCCAGAAAGUAGAGGGC | 896 | GCCCUCUACUUUCUGGCGC | 1465 |
| NM_001735.2_2691-2709_s | 2691-2709 | AGUAGAGGGCUCCUCCAGU | 897 | ACUGGAGGAGCCCUCUACU | 1466 |
| NM_001735.2_2702-2720_s | 2702-2720 | CCUCCAGUCACUUGGUGAC | 898 | GUCACCAAGUGACUGGAGG | 1467 |
| NM_001735.2_2709-2727_s | 2709-2727 | UCACUUGGUGACAUUCACU | 899 | AGUGAAUGUCACCAAGUGA | 1468 |
| NM_001735.2_2720-2738_s | 2720-2738 | CAUUCACUGUGCUUCCUCU | 900 | AGAGGAAGCACAGUGAAUG | 1469 |
| NM_001735.2_2739-2757_s | 2739-2757 | GGAAAUUGGCCUUCACAAC | 901 | GUUGUGAAGGCCAAUUUCC | 1470 |
| NM_001735.2_2749-2767_s | 2749-2767 | CUUCACAACAUCAAUUUUU | 902 | AAAAAUUGAUGUUGUGAAG | 1471 |
| NM_001735.2_2761-2779_s | 2761-2779 | AAUUUUUCACUGGAGACUU | 903 | AAGUCUCCAGUGAAAAAUU | 1472 |
| NM_001735.2_2770-2788_s | 2770-2788 | CUGGAGACUUGGUUUGGAA | 904 | UUCCAAACCAAGUCUCCAG | 1473 |
| NM_001735.2_2780-2798_s | 2780-2798 | GGUUUGGAAAAGAAAUCUU | 905 | AAGAUUUCUUUUCCAAACC | 1474 |
| NM_001735.2_2793-2811_s | 2793-2811 | AAUCUUAGUAAAAACAUUA | 906 | UAAUGUUUUUACUAAGAUU | 1475 |
| NM_001735.2_2802-2820_s | 2802-2820 | AAAAACAUUACGAGUGGUG | 907 | CACCACUCGUAAUGUUUUU | 1476 |
| NM_001735.2_2813-2831_s | 2813-2831 | GAGUGGUGCCAGAAGGUGU | 908 | ACACCUUCUGGCACCACUC | 1477 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_2823-2841_s | 2823-2841 | AGAAGGUGUCAAAAGGGAA | 909 | UUCCCUUUUGACACCUUCU | 1478 |
| NM_001735.2_2829-2847_s | 2829-2847 | UGUCAAAAGGGAAAGCUAU | 910 | AUAGCUUUCCCUUUUGACA | 1479 |
| NM_001735.2_2843-2861_s | 2843-2861 | GCUAUUCUGGUGUUACUUU | 911 | AAAGUAACACCAGAAUAGC | 1480 |
| NM_001735.2_2852-2870_s | 2852-2870 | GUGUUACUUUGGAUCCUAG | 912 | CUAGGAUCCAAAGUAACAC | 1481 |
| NM_001735.2_2862-2880_s | 2862-2880 | GGAUCCUAGGGGUAUUUAU | 913 | AUAAAUACCCCUAGGAUCC | 1482 |
| NM_001735.2_2872-2890_s | 2872-2890 | GGUAUUUAUGGUACCAUUA | 914 | UAAUGGUACCAUAAAUACC | 1483 |
| NM_001735.2_2882-2900_s | 2882-2900 | GUACCAUUAGCAGACGAAA | 915 | UUUCGUCUGCUAAUGGUAC | 1484 |
| NM_001735.2_2892-2910_s | 2892-2910 | CAGACGAAAGGAGUUCCCA | 916 | UGGGAACUCCUUUCGUCUG | 1485 |
| NM_001735.2_2900-2918_s | 2900-2918 | AGGAGUUCCCAUACAGGAU | 917 | AUCCUGUAUGGGAACUCCU | 1486 |
| NM_001735.2_2909-2927_s | 2909-2927 | CAUACAGGAUACCCUUAGA | 918 | UCUAAGGGUAUCCUGUAUG | 1487 |
| NM_001735.2_2922-2940_s | 2922-2940 | CUUAGAUUUGGUCCCCAAA | 919 | UUUGGGGACCAAAUCUAAG | 1488 |
| NM_001735.2_2933-2951_s | 2933-2951 | UCCCCAAAACAGAAAUCAA | 920 | UUGAUUUCUGUUUUGGGGA | 1489 |
| NM_001735.2_2941-2959_s | 2941-2959 | ACAGAAAUCAAAAGGAUUU | 921 | AAAUCCUUUUGAUUUCUGU | 1490 |
| NM_001735.2_2951-2969_s | 2951-2969 | AAAGGAUUUUGAGUGUAAA | 922 | UUUACACUCAAAAUCCUUU | 1491 |
| NM_001735.2_2962-2980_s | 2962-2980 | AGUGUAAAAGGACUGCUUG | 923 | CAAGCAGUCCUUUUACACU | 1492 |
| NM_001735.2_2969-2987_s | 2969-2987 | AAGGACUGCUUGUAGGUGA | 924 | UCACCUACAAGCAGUCCUU | 1493 |
| NM_001735.2_2980-2998_s | 2980-2998 | GUAGGUGAGAUCUUGUCUG | 925 | CAGACAAGAUCUCACCUAC | 1494 |
| NM_001735.2_2989-3007_s | 2989-3007 | AUCUUGUCUGCAGUUCUAA | 926 | UUAGAACUGCAGACAAGAU | 1495 |
| NM_001735.2_3001-3019_s | 3001-3019 | GUUCUAAGUCAGGAAGGCA | 927 | UGCCUUCCUGACUUAGAAC | 1496 |
| NM_001735.2_3013-3031_s | 3013-3031 | GAAGGCAUCAAUAUCCUAA | 928 | UUAGGAUAUUGAUGCCUUC | 1497 |
| NM_001735.2_3020-3038_s | 3020-3038 | UCAAUAUCCUAACCCACCU | 929 | AGGUGGGUUAGGAUAUUGA | 1498 |
| NM_001735.2_3033-3051_s | 3033-3051 | CCACCUCCCCAAAGGGAGU | 930 | ACUCCCUUUGGGGAGGUGG | 1499 |
| NM_001735.2_3039-3057_s | 3039-3057 | CCCCAAAGGGAGUGCAGAG | 931 | CUCUGCACUCCCUUUGGGG | 1500 |
| NM_001735.2_3050-3068_s | 3050-3068 | GUGCAGAGGCGGAGCUGAU | 932 | AUCAGCUCCGCCUCUGCAC | 1501 |
| NM_001735.2_3060-3078_s | 3060-3078 | GGAGCUGAUGAGCGUUGUC | 933 | GACAACGCUCAUCAGCUCC | 1502 |
| NM_001735.2_3072-3090_s | 3072-3090 | CGUUGUCCCAGUAUUCUAU | 934 | AUAGAAUACUGGGACAACG | 1503 |
| NM_001735.2_3079-3097_s | 3079-3097 | CCAGUAUUCUAUGUUUUUC | 935 | GAAAAACAUAGAAUACUGG | 1504 |
| NM_001735.2_3091-3109_s | 3091-3109 | GUUUUUCACUACCUGGAAA | 936 | UUUCCAGGUAGUGAAAAAC | 1505 |
| NM_001735.2_3102-3120_s | 3102-3120 | CCUGGAAACAGGAAAUCAU | 937 | AUGAUUUCCUGUUUCCAGG | 1506 |
| NM_001735.2_3122-3140_s | 3122-3140 | GGAACAUUUUCAUUCUGA | 938 | UCAGAAUGAAAAUGUUCC | 1507 |
| NM_001735.2_3133-3151_s | 3133-3151 | CAUUCUGACCCAUUAAUUG | 939 | CAAUUAAUGGGUCAGAAUG | 1508 |
| NM_001735.2_3142-3160_s | 3142-3160 | CCAUUAAUUGAAAAGCAGA | 940 | UCUGCUUUUCAAUUAAUGG | 1509 |
| NM_001735.2_3153-3171_s | 3153-3171 | AAAGCAGAAACUGAAGAAA | 941 | UUUCUUCAGUUUCUGCUUU | 1510 |
| NM_001735.2_3161-3179_s | 3161-3179 | AACUGAAGAAAAAUUAAA | 942 | UUUAAUUUUUCUUCAGUU | 1511 |
| NM_001735.2_3169-3187_s | 3169-3187 | AAAAAUUAAAAGAAGGGA | 943 | UCCCUUCUUUUAAUUUUU | 1512 |
| NM_001735.2_3183-3201_s | 3183-3201 | AGGGAUGUUGAGCAUUAUG | 944 | CAUAAUGCUCAACAUCCCU | 1513 |
| NM_001735.2_3192-3210_s | 3192-3210 | GAGCAUUAUGUCCUACAGA | 945 | UCUGUAGGACAUAAUGCUC | 1514 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_3200-3218_s | 3200-3218 | UGUCCUACAGAAAUGCUGA | 946 | UCAGCAUUUCUGUAGGACA | 1515 |
| NM_001735.2_3211-3229_s | 3211-3229 | AAUGCUGACUACUCUUACA | 947 | UGUAAGAGUAGUCAGCAUU | 1516 |
| NM_001735.2_3220-3238_s | 3220-3238 | UACUCUUACAGUGUGUGGA | 948 | UCCACACACUGUAAGAGUA | 1517 |
| NM_001735.2_3229-3247_s | 3229-3247 | AGUGUGUGGAAGGGUGGAA | 949 | UUCCACCCUUCCACACACU | 1518 |
| NM_001735.2_3240-3258_s | 3240-3258 | GGGUGGAAGUGCUAGCACU | 950 | AGUGCUAGCACUUCCACCC | 1519 |
| NM_001735.2_3250-3268_s | 3250-3268 | GCUAGCACUUGGUUAACAG | 951 | CUGUUAACCAAGUGCUAGC | 1520 |
| NM_001735.2_3260-3278_s | 3260-3278 | GGUUAACAGCUUUUGCUUU | 952 | AAAGCAAAAGCUGUUAACC | 1521 |
| NM_001735.2_3273-3291_s | 3273-3291 | UGCUUUAAGAGUACUUGGA | 953 | UCCAAGUACUCUUAAAGCA | 1522 |
| NM_001735.2_3283-3301_s | 3283-3301 | GUACUUGGACAAGUAAAUA | 954 | UAUUUACUUGUCCAAGUAC | 1523 |
| NM_001735.2_3292-3310_s | 3292-3317 | CAAGUAAAUAAAUACGUAG | 955 | CUACGUAUUUAUUUACUUG | 1524 |
| NM_001735.2_3299-3317_s | 3299-3317 | AUAAAUACGUAGAGCAGAA | 956 | UUCUGCUCUACGUAUUUAU | 1525 |
| NM_001735.2_3310-3328_s | 3310-3328 | GAGCAGAACCAAAAUUCAA | 957 | UUGAAUUUUGGUUCUGCUC | 1526 |
| NM_001735.2_3322-3340_s | 3322-3340 | AAUUCAAUUUGUAAUUCUU | 958 | AAGAAUUACAAAUUGAAUU | 1527 |
| NM_001735.2_3332-3350_s | 3332-3350 | GUAAUUCUUUAUUGUGGCU | 959 | AGCCACAAUAAAGAAUUAC | 1528 |
| NM_001735.2_3342-3360_s | 3342-3360 | AUUGUGGCUAGUUGAGAAU | 960 | AUUCUCAACUAGCCACAAU | 1529 |
| NM_001735.2_3349-3367_s | 3349-3367 | CUAGUUGAGAAUUAUCAAU | 961 | AUUGAUAAUUCUCAACUAG | 1530 |
| NM_001735.2_3360-3378_s | 3360-3378 | UUAUCAAUUAGAUAAUGGA | 962 | UCCAUUAUCUAAUUGAUAA | 1531 |
| NM_001735.2_3373-3391_s | 3373-3391 | AAUGGAUCUUUCAAGGAAA | 963 | UUUCCUUGAAAGAUCCAUU | 1532 |
| NM_001735.2_3380-3398_s | 3380-3398 | CUUUCAAGGAAAAUUCACA | 964 | UGUGAAUUUUCCUUGAAAG | 1533 |
| NM_001735.2_3391-3409_s | 3391-3409 | AAUUCACAGUAUCAACCAA | 965 | UUGGUUGAUACUGUGAAUU | 1534 |
| NM_001735.2_3399-3417_s | 3399-3417 | GUAUCAACCAAUAAAAUUA | 966 | UAAUUUUAUUGGUUGAUAC | 1535 |
| NM_001735.2_3411-3429_s | 3411-3429 | AAAAUUACAGGGUACCUUG | 967 | CAAGGUACCCUGUAAUUUU | 1536 |
| NM_001735.2_3419-3437_s | 3419-3437 | AGGGUACCUUGCCUGUUGA | 968 | UCAACAGGCAAGGUACCCU | 1537 |
| NM_001735.2_3433-3451_s | 3433-3451 | GUUGAAGCCCGAGAGAACA | 969 | UGUUCUCUCGGGCUUCAAC | 1538 |
| NM_001735.2_3441-3459_s | 3441-3559 | CCGAGAGAACAGCUUAUAU | 970 | AUAUAAGCUGUUCUCUCGG | 1539 |
| NM_001735.2_3452-3470_s | 3452-3470 | GCUUAUAUCUUACAGCCUU | 971 | AAGGCUGUAAGAUAUAAGC | 1540 |
| NM_001735.2_3460-3478_s | 3460-3478 | CUUACAGCCUUUACUGUGA | 972 | UCACAGUAAAGGCUGUAAG | 1541 |
| NM_001735.2_3482-3500_s | 3482-3500 | GAAUUAGAAAGGCUUUCGA | 973 | UCGAAAGCCUUUCUAAUUC | 1542 |
| NM_001735.2_3492-3510_s | 3492-3510 | GGCUUUCGAUAUAUGCCCC | 974 | GGGGCAUAUAUCGAAAGCC | 1543 |
| NM_001735.2_3499-3517_s | 3499-3517 | GAUAUAUGCCCCUGGUGA | 975 | UCACCAGGGGCAUAUAUC | 1544 |
| NM_001735.2_3513-3531_s | 3513-3531 | GGUGAAAUCGACACAGCU | 976 | AGCUGUGUCGAUUUCACC | 1545 |
| NM_001735.2_3522-3540_s | 3522-3540 | CGACACAGCUCUAAUUAAA | 977 | UUUAAUUAGAGCUGUGUCG | 1546 |
| NM_001735.2_3529-3547_s | 3529-3547 | GCUCUAAUUAAAGCUGACA | 978 | UGUCAGCUUUAAUUAGAGC | 1547 |
| NM_001735.2_3542-3560_s | 3542-3560 | CUGACAACUUUCUGCUUGA | 979 | UCAAGCAGAAAGUUGUCAG | 1548 |
| NM_001735.2_3549-3567_s | 3549-3567 | CUUUCUGCUUGAAAAUACA | 980 | UGUAUUUUCAAGCAGAAAG | 1549 |
| NM_001735.2_3560-3578_s | 3560-3578 | AAAAUACACUGCCAGCCCA | 981 | UGGGCUGGCAGUGUAUUUU | 1550 |
| NM_001735.2_3573-3591_s | 3573-3591 | AGCCCAGAGCACCUUUACA | 982 | UGUAAAGGUGCUCUGGGCU | 1551 |
| NM_001735.2_3581-3599_s | 3581-3599 | GCACCUUUACAUUGGCCAU | 983 | AUGGCCAAUGUAAAGGUGC | 1552 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_3589-3607_s | 3589-3607 | ACAUUGGCCAUUUCUGCGU | 984 | ACGCAGAAAUGGCCAAUGU | 1553 |
| NM_001735.2_3602-3620_s | 3602-3620 | CUGCGUAUGCUCUUUCCCU | 985 | AGGGAAAGAGCAUACGCAG | 1554 |
| NM_001735.2_3613-3631_s | 3613-3631 | CUUUCCCUGGGAGAUAAAA | 986 | UUUUAUCUCCCAGGGAAAG | 1555 |
| NM_001735.2_3623-3641_s | 3623-3641 | GAGAUAAAACUCACCCACA | 987 | UGUGGGUGAGUUUUAUCUC | 1556 |
| NM_001735.2_3631-3649_s | 3631-3649 | ACUCACCCACAGUUUCGUU | 988 | AACGAAACUGUGGGUGAGU | 1557 |
| NM_001735.2_3640-3658_s | 3640-3658 | CAGUUUCGUUCAAUUGUUU | 989 | AAACAAUUGAACGAAACUG | 1558 |
| NM_001735.2_3650-3668_s | 3650-3668 | CAAUUGUUUCAGCUUUGAA | 990 | UUCAAAGCUGAAACAAUUG | 1559 |
| NM_001735.2_3662-3680_s | 3662-3680 | CUUUGAAGAGAGAAGCUUU | 991 | AAAGCUUCUCUCUUCAAAG | 1560 |
| NM_001735.2_3669-3687_s | 3669-3687 | GAGAGAAGCUUUGGUUAAA | 992 | UUUAACCAAAGCUUCUCUC | 1561 |
| NM_001735.2_3682-3700_s | 3682-3700 | GUUAAAGGUAAUCCACCCA | 993 | UGGGUGGAUUACCUUUAAC | 1562 |
| NM_001735.2_3691-3709_s | 3691-3709 | AAUCCACCCAUUUAUCGUU | 994 | AACGAUAAAUGGGUGGAUU | 1563 |
| NM_001735.2_3699-3717_s | 3699-3717 | CAUUUAUCGUUUUGGAAA | 995 | UUUCCAAAAACGAUAAAUG | 1564 |
| NM_001735.2_3710-3728_s | 3710-3728 | UUUGGAAAGACAAUCUUCA | 996 | UGAAGAUUGUCUUUCCAAA | 1565 |
| NM_001735.2_3721-3739_s | 3721-3739 | AAUCUUCAGCAUAAAGACA | 997 | UGUCUUUAUGCUGAAGAUU | 1566 |
| NM_001735.2_3730-3748_s | 3730-3748 | CAUAAAGACAGCUCUGUAC | 998 | GUACAGAGCUGUCUUUAUG | 1567 |
| NM_001735.2_3741-3759_s | 3741-3759 | CUCUGUACCUAACACUGGU | 999 | ACCAGUGUUAGGUACAGAG | 1568 |
| NM_001735.2_3752-3770_s | 3752-3770 | ACACUGGUACGGCACGUAU | 1000 | AUACGUGCCGUACCAGUGU | 1569 |
| NM_001735.2_3762-3780_s | 3762-3780 | GGCACGUAUGGUAGAAACA | 1001 | UGUUUCUACCAUACGUGCC | 1570 |
| NM_001735.2_3771-3789_s | 3771-3789 | GGUAGAAACAACUGCCUAU | 1002 | AUAGGCAGUUGUUUCUACC | 1571 |
| NM_001735.2_3779-3797_s | 3779-3797 | CAACUGCCUAUGCUUUACU | 1003 | AGUAAAGCAUAGGCAGUUG | 1572 |
| NM_001735.2_3791-3809_s | 3791-3809 | CUUUACUCACCAGUCUGAA | 1004 | UUCAGACUGGUGAGUAAAG | 1573 |
| NM_001735.2_3803-3821_s | 3803-3821 | GUCUGAACUUGAAAGAUAU | 1005 | AUAUCUUUCAAGUUCAGAC | 1574 |
| NM_001735.2_3809-3827_s | 3809-3827 | ACUUGAAAGAUAUAAAUUA | 1006 | UAAUUUAUAUCUUUCAAGU | 1575 |
| NM_001735.2_3819-3837_s | 3819-3837 | UAUAAAUUAUGUUAACCCA | 1007 | UGGGUUAACAUAAUUUAUA | 1576 |
| NM_001735.2_3829-3847_s | 3829-3847 | GUUAACCCAGUCAUCAAAU | 1008 | AUUUGAUGACUGGGUUAAC | 1577 |
| NM_001735.2_3839-3857_s | 3839-3857 | UCAUCAAAUGGCUAUCAGA | 1009 | UCUGAUAGCCAUUUGAUGA | 1578 |
| NM_001735.2_3851-3869_s | 3851-3869 | UAUCAGAAGAGCAGAGGUA | 1010 | UACCUCUGCUCUUCUGAUA | 1579 |
| NM_001735.2_3863-3881_s | 3863-3881 | AGAGGUAUGGAGGUGGCUU | 1011 | AAGCCACCUCCAUACCUCU | 1580 |
| NM_001735.2_3872-3890_s | 3872-3890 | GAGGUGGCUUUUAUUCAAC | 1012 | GUUGAAUAAAAGCCACCUC | 1581 |
| NM_001735.2_3883-3901_s | 3883-3901 | UAUUCAACCCAGGACACAA | 1013 | UUGUGUCCUGGGUUGAAUA | 1582 |
| NM_001735.2_3893-3911_s | 3893-3911 | AGGACACAAUCAAUGCCAU | 1014 | AUGGCAUUGAUUGUGUCCU | 1583 |
| NM_001735.2_3899-3917_s | 3899-3917 | CAAUCAAUGCCAUUGAGGG | 1015 | CCCUCAAUGGCAUUGAUUG | 1584 |
| NM_001735.2_3909-3927_s | 3909-3927 | CAUUGAGGGCCUGACGGAA | 1016 | UUCCGUCAGGCCCUCAAUG | 1585 |
| NM_001735.2_3922-3940_s | 3922-3940 | ACGGAAUAUUCACUCCUGG | 1017 | CCAGGAGUGAAUAUUCCGU | 1586 |
| NM_001735.2_3930-3948_s | 3930-3948 | UUCACUCCUGGUUAAACAA | 1018 | UUGUUUAACCAGGAGUGAA | 1587 |
| NM_001735.2_3939-3957_s | 3939-3957 | GGUUAAACAACUCCGCUUG | 1019 | CAAGCGGAGUUGUUUAACC | 1588 |
| NM_001735.2_3951-3969_s | 3951-3969 | CCGCUUGAGUAUGGACAUC | 1020 | GAUGUCCAUACUCAAGCGG | 1589 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_3963-3981_s | 3963-3981 | GGACAUCGAUGUUUCUUAC | 1021 | GUAAGAAACAUCGAUGUCC | 1590 |
| NM_001735.2_3969-3987_s | 3969-3987 | CGAUGUUUCUUACAAGCAU | 1022 | AUGCUUGUAAGAAACAUCG | 1591 |
| NM_001735.2_3981-3999_s | 3981-3999 | CAAGCAUAAAGGUGCCUUA | 1023 | UAAGGCACCUUUAUGCUUG | 1592 |
| NM_001735.2_3992-4010_s | 3992-4010 | GUGCCUUACAUAAUUAUAA | 1024 | UUAUAAUUAUGUAAGGCAC | 1593 |
| NM_001735.2_3999-4017_s | 3999-4017 | ACAUAAUUAUAAAAUGACA | 1025 | UGUCAUUUUAUAAUUAUGU | 1594 |
| NM_001735.2_4009-4027_s | 4009-4027 | AAAAUGACAGACAAGAAUU | 1026 | AAUUCUUGUCUGUCAUUUU | 1595 |
| NM_001735.2_4020-4038_s | 4020-4038 | CAAGAAUUUCCUUGGGAGG | 1027 | CCUCCCAAGGAAAUUCUUG | 1596 |
| NM_001735.2_4029-4047_s | 4029-4047 | CCUUGGGAGGCCAGUAGAG | 1028 | CUCUACUGGCCUCCCAAGG | 1597 |
| NM_001735.2_4041-4059_s | 4041-4059 | AGUAGAGGUGCUUCUCAAU | 1029 | AUUGAGAAGCACCUCUACU | 1598 |
| NM_001735.2_4051-4069_s | 4051-4069 | CUUCUCAAUGAUGACCUCA | 1030 | UGAGGUCAUCAUUGAGAAG | 1599 |
| NM_001735.2_4062-4080_s | 4062-4080 | UGACCUCAUUGUCAGUACA | 1031 | UGUACUGACAAUGAGGUCA | 1600 |
| NM_001735.2_4072-4090_s | 4072-4090 | GUCAGUACAGGAUUUGGCA | 1032 | UGCCAAAUCCUGUACUGAC | 1601 |
| NM_001735.2_4080-4098_s | 4080-4098 | AGGAUUUGGCAGUGGCUUG | 1033 | CAAGCCACUGCCAAAUCCU | 1602 |
| NM_001735.2_4092-4110_s | 4092-4110 | UGGCUUGGCUACAGUACAU | 1034 | AUGUACUGUAGCCAAGCCA | 1603 |
| NM_001735.2_4099-4117_s | 4099-4117 | GCUACAGUACAUGUAACAA | 1035 | UUGUUACAUGUACUGUAGC | 1604 |
| NM_001735.2_4113-4131_s | 4113-4131 | AACAACUGUAGUUCACAAA | 1036 | UUUGUGAACUACAGUUGUU | 1605 |
| NM_001735.2_4120-4138_s | 4120-4138 | GUAGUUCACAAAACCAGUA | 1037 | UACUGGUUUUGUGAACUAC | 1606 |
| NM_001735.2_4130-4148_s | 4130-4148 | AAACCAGUACCUCUGAGGA | 1038 | UCCUCAGAGGUACUGGUUU | 1607 |
| NM_001735.2_4143-4161_s | 4143-4161 | UGAGGAAGUUUGCAGCUUU | 1039 | AAAGCUGCAAACUUCCUCA | 1608 |
| NM_001735.2_4153-4171_s | 4153-4171 | UGCAGCUUUUAUUGAAAA | 1040 | UUUUCAAAUAAAAGCUGCA | 1609 |
| NM_001735.2_4163-4181_s | 4163-4181 | AUUUGAAAAUCGAUACUCA | 1041 | UGAGUAUCGAUUUUCAAAU | 1610 |
| NM_001735.2_4173-4191_s | 4173-4191 | CGAUACUCAGGAUAUUGAA | 1042 | UUCAAUAUCCUGAGUAUCG | 1611 |
| NM_001735.2_4182-4200_s | 4182-4200 | GGAUAUUGAAGCAUCCCAC | 1043 | GUGGGAUGCUUCAAUAUCC | 1612 |
| NM_001735.2_4189-4207_s | 4189-4207 | GAAGCAUCCCACUACAGAG | 1044 | CUCUGUAGUGGGAUGCUUC | 1613 |
| NM_001735.2_4199-4217_s | 4199-4217 | ACUACAGAGGCUACGGAAA | 1045 | UUUCCGUAGCCUCUGUAGU | 1614 |
| NM_001735.2_4212-4230_s | 4212-4230 | CGGAAACUCUGAUUACAAA | 1046 | UUUGUAAUCAGAGUUUCCG | 1615 |
| NM_001735.2_4221-4239_s | 4221-4239 | UGAUUACAAACGCAUAGUA | 1047 | UACUAUGCGUUUGUAAUCA | 1616 |
| NM_001735.2_4232-4250_s | 4232-4250 | GCAUAGUAGCAUGUGCCAG | 1048 | CUGGCACAUGCUACUAUGC | 1617 |
| NM_001735.2_4240-4258_s | 4240-4258 | GCAUGUGCCAGCUACAAGC | 1049 | GCUUGUAGCUGGCACAUGC | 1618 |
| NM_001735.2_4251-4269_s | 4251-4269 | CUACAAGCCCAGCAGGGAA | 1050 | UUCCCUGCUGGGCUUGUAG | 1619 |
| NM_001735.2_4260-4278_s | 4260-4278 | CAGCAGGGAAGAAUCAUCA | 1051 | UGAUGAUUCUUCCCUGCUG | 1620 |
| NM_001735.2_4270-4288_s | 4270-4288 | GAAUCAUCAUCUGGAUCCU | 1052 | AGGAUCCAGAUGAUGAUUC | 1621 |
| NM_001735.2_4283-4301_s | 4283-4301 | GAUCCUCUCAUGCGGUGAU | 1053 | AUCACCGCAUGAGAGGAUC | 1622 |
| NM_001735.2_4289-4307_s | 4289-4307 | CUCAUGCGGUGAUGGACAU | 1054 | AUGUCCAUCACCGCAUGAG | 1623 |
| NM_001735.2_4299-4317_s | 4299-4317 | GAUGGACAUCUCCUUGCCU | 1055 | AGGCAAGGAGAUGUCCAUC | 1624 |
| NM_001735.2_4311-4329_s | 4311-4329 | CUUGCCUACUGGAAUCAGU | 1056 | ACUGAUUCCAGUAGGCAAG | 1625 |
| NM_001735.2_4322-4340_s | 4322-4340 | GAAUCAGUGCAAAUGAAGA | 1057 | UCUUCAUUUGCACUGAUUC | 1626 |
| NM_001735.2_4332-4350_s | 4332-4350 | AAAUGAAGAAGACUUAAAA | 1058 | UUUUAAGUCUUCUUCAUUU | 1627 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_4339-4357_s | 4339-4357 | GAAGACUUAAAAGCCCUUG | 1059 | CAAGGGCUUUUAAGUCUUC | 1628 |
| NM_001735.2_4353-4371_s | 4353-4371 | CCUUGUGGAAGGGGUGGAU | 1060 | AUCCACCCCUUCCACAAGG | 1629 |
| NM_001735.2_4360-4378_s | 4360-4378 | GAAGGGGUGGAUCAACUAU | 1061 | AUAGUUGAUCCACCCCUUC | 1630 |
| NM_001735.2_4370-4388_s | 4370-4388 | AUCAACUAUUCACUGAUUA | 1062 | UAAUCAGUGAAUAGUUGAU | 1631 |
| NM_001735.2_4380-4398_s | 4380-4398 | CACUGAUUACCAAAUCAAA | 1063 | UUUGAUUUGGUAAUCAGUG | 1632 |
| NM_001735.2_4393-4411_s | 4393-4411 | AUCAAAGAUGGACAUGUUA | 1064 | UAACAUGUCCAUCUUUGAU | 1633 |
| NM_001735.2_4402-4420_s | 4402-4420 | GGACAUGUUAUUCUGCAAC | 1065 | GUUGCAGAAUAACAUGUCC | 1634 |
| NM_001735.2_4413-4431_s | 4413-4431 | UCUGCAACUGAAUUCGAUU | 1066 | AAUCGAAUUCAGUUGCAGA | 1635 |
| NM_001735.2_4422-4440_s | 4422-4440 | GAAUUCGAUUCCCUCCAGU | 1067 | ACUGGAGGGAAUCGAAUUC | 1636 |
| NM_001735.2_4432-4450_s | 4432-4450 | CCCUCCAGUGAUUUCCUUU | 1068 | AAAGGAAAUCACUGGAGGG | 1637 |
| NM_001735.2_4441-4459_s | 4441-4459 | GAUUUCCUUUGUGUACGAU | 1069 | AUCGUACACAAAGGAAAUC | 1638 |
| NM_001735.2_4453-4471_s | 4453-4471 | GUACGAUUCCGGAUAUUUG | 1070 | CAAAUAUCCGGAAUCGUAC | 1639 |
| NM_001735.2_4462-4480_s | 4462-4480 | CGGAUAUUUGAACUCUUUG | 1071 | CAAAGAGUUCAAAUAUCCG | 1640 |
| NM_001735.2_4473-4491_s | 4473-4491 | ACUCUUUGAAGUUGGGUUU | 1072 | AAACCCAACUUCAAAGAGU | 1641 |
| NM_001735.2_4482-4500_s | 4482-4500 | AGUUGGGUUUCUCAGUCCU | 1073 | AGGACUGAGAAACCCAACU | 1642 |
| NM_001735.2_4490-4508_s | 4490-4508 | UUCUCAGUCCUGCCACUUU | 1074 | AAAGUGGCAGGACUGAGAA | 1643 |
| NM_001735.2_4503-4521_s | 4503-4521 | CACUUUCACAGUGUACGAA | 1075 | UUCGUACACUGUGAAAGUG | 1644 |
| NM_001735.2_4509-4527_s | 4509-4527 | CACAGUGUACGAAUACCAC | 1076 | GUGGUAUUCGUACACUGUG | 1645 |
| NM_001735.2_4523-4541_s | 4523-4541 | ACCACAGACCAGAUAAACA | 1077 | UGUUUAUCUGGUCUGUGGU | 1646 |
| NM_001735.2_4531-4549_s | 4531-4549 | CCAGAUAAACAGUGUACCA | 1078 | UGGUACACUGUUUAUCUGG | 1647 |
| NM_001735.2_4540-4558_s | 4540-4558 | CAGUGUACCAUGUUUUAUA | 1079 | UAUAAAACAUGGUACACUG | 1648 |
| NM_001735.2_4551-4569_s | 4551-4569 | GUUUUAUAGCACUUCCAAU | 1080 | AUUGGAAGUGCUAUAAAAC | 1649 |
| NM_001735.2_4562-4580_s | 4562-4580 | CUUCCAAUAUCAAAAUUCA | 1081 | UGAAUUUUGAUAUUGGAAG | 1650 |
| NM_001735.2_4570-4588_s | 4570-4588 | AUCAAAAUUCAGAAAGUCU | 1082 | AGACUUUCUGAAUUUUGAU | 1651 |
| NM_001735.2_4581-4599_s | 4581-4599 | GAAAGUCUGUGAAGGAGCC | 1083 | GGCUCCUUCACAGACUUUC | 1652 |
| NM_001735.2_4591-4609_s | 4591-4609 | GAAGGAGCCGCGUGCAAGU | 1084 | ACUUGCACGCGGCUCCUUC | 1653 |
| NM_001735.2_4601-4619_s | 4601-4619 | CGUGCAAGUGUGUAGAAGC | 1085 | GCUUCUACACACUUGCACG | 1654 |
| NM_001735.2_4612-4630_s | 4612-4630 | GUAGAAGCUGAUUGUGGGC | 1086 | GCCCACAAUCAGCUUCUAC | 1655 |
| NM_001735.2_4619-4637_s | 4619-4637 | CUGAUUGUGGGCAAAUGCA | 1087 | UGCAUUUGCCCACAAUCAG | 1656 |
| NM_001735.2_4629-4647_s | 4629-4647 | GCAAAUGCAGGAAGAAUUG | 1088 | CAAUUCUUCCUGCAUUUGC | 1657 |
| NM_001735.2_4639-4657_s | 4639-4657 | GAAGAAUUGGAUCUGACAA | 1089 | UUGUCAGAUCCAAUUCUUC | 1658 |
| NM_001735.2_4651-4669_s | 4651-4669 | CUGACAAUCUCUGCAGAGA | 1090 | UCUCUGCAGAGAUUGUCAG | 1659 |
| NM_001735.2_4663-4681_s | 4663-4681 | GCAGAGACAAGAAAACAAA | 1091 | UUUGUUUUCUUGUCUCUGC | 1660 |
| NM_001735.2_4670-4688_s | 4670-4688 | CAAGAAACAAACAGCAUG | 1092 | CAUGCUGUUUGUUUUCUUG | 1661 |
| NM_001735.2_4681-4699_s | 4681-4699 | ACAGCAUGUAAACCAGAGA | 1093 | UCUCUGGUUUACAUGCUGU | 1662 |
| NM_001735.2_4693-4711_s | 4693-4711 | CCAGAGAUUGCAUAUGCUU | 1094 | AAGCAUAUGCAAUCUCUGG | 1663 |
| NM_001735.2_4702-4720_s | 4702-4720 | GCAUAUGCUUAUAAAGUUA | 1095 | UAACUUUAUAAGCAUAUGC | 1664 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_4710-4728_s | 4710-4728 | UUAUAAAGUUAGCAUCACA | 1096 | UGUGAUGCUAACUUUAUAA | 1665 |
| NM_001735.2_4722-4740_s | 4722-4740 | CAUCACAUCCAUCACUGUA | 1097 | UACAGUGAUGGAUGUGAUG | 1666 |
| NM_001735.2_4733-4751_s | 4733-4751 | UCACUGUAGAAAAUGUUUU | 1098 | AAAACAUUUUCUACAGUGA | 1667 |
| NM_001735.2_4740-4758_s | 4740-4758 | AGAAAAUGUUUUUGUCAAG | 1099 | CUUGACAAAAACAUUUUCU | 1668 |
| NM_001735.2_4750-4768_s | 4750-4768 | UUUGUCAAGUACAAGGCAA | 1100 | UUGCCUUGUACUUGACAAA | 1669 |
| NM_001735.2_4763-4781_s | 4763-4781 | AGGCAACCCUUCUGGAUAU | 1101 | AUAUCCAGAAGGGUUGCCU | 1670 |
| NM_001735.2_4770-4788_s | 4770-4788 | CCUUCUGGAUAUCUACAAA | 1102 | UUUGUAGAUAUCCAGAAGG | 1671 |
| NM_001735.2_4779-4797_s | 4779-4797 | UAUCUACAAAACUGGGGAA | 1103 | UUCCCCAGUUUUGUAGAUA | 1672 |
| NM_001735.2_4790-4808_s | 4790-4808 | CUGGGGAAGCUGUUGCUGA | 1104 | UCAGCAACAGCUUCCCCAG | 1673 |
| NM_001735.2_4799-4817_s | 4799-4817 | CUGUUGCUGAGAAAGACUC | 1105 | GAGUCUUUCUCAGCAACAG | 1674 |
| NM_001735.2_4813-4831_s | 4813-4831 | GACUCUGAGAUUACCUUCA | 1106 | UGAAGGUAAUCUCAGAGUC | 1675 |
| NM_001735.2_4819-4837_s | 4819-4837 | GAGAUUACCUUCAUUAAAA | 1107 | UUUUAAUGAAGGUAAUCUC | 1676 |
| NM_001735.2_4831-4849_s | 4831-4849 | AUUAAAAGGUAACCUGUA | 1108 | UACAGGUUACCUUUUUAAU | 1677 |
| NM_001735.2_4841-4859_s | 4841-4859 | UAACCUGUACUAACGCUGA | 1109 | UCAGCGUUAGUACAGGUUA | 1678 |
| NM_001735.2_4850-4868_s | 4850-4868 | CUAACGCUGAGCUGGUAAA | 1110 | UUUACCAGCUCAGCGUUAG | 1679 |
| NM_001735.2_4863-4881_s | 4863-4881 | GGUAAAAGGAAGACAGUAC | 1111 | GUACUGUCUUCCUUUUACC | 1680 |
| NM_001735.2_4871-4889_s | 4871-4889 | GAAGACAGUACUUAAUUAU | 1112 | AUAAUUAAGUACUGUCUUC | 1681 |
| NM_001735.2_4881-4899_s | 4881-4899 | CUUAAUUAUGGGUAAAGAA | 1113 | UUCUUUACCCAUAAUUAAG | 1682 |
| NM_001735.2_4893-4911_s | 4893-4911 | UAAAGAAGCCCUCCAGAUA | 1114 | UAUCUGGAGGGCUUCUUUA | 1683 |
| NM_001735.2_4902-4920_s | 4902-4920 | CCUCCAGAUAAAAUACAAU | 1115 | AUUGUAUUUUAUCUGGAGG | 1684 |
| NM_001735.2_4912-4930_s | 4912-4930 | AAAUACAAUUUCAGUUUCA | 1116 | UGAAACUGAAAUUGUAUUU | 1685 |
| NM_001735.2_4923-4941_s | 4923-4941 | CAGUUUCAGGUACAUCUAC | 1117 | GUAGAUGUACCUGAAACUG | 1686 |
| NM_001735.2_4931-4949_s | 4931-4949 | GGUACAUCUACCCUUUAGA | 1118 | UCUAAAGGGUAGAUGUACC | 1687 |
| NM_001735.2_4942-4960_s | 4942-4960 | CCUUUAGAUUCCUUGACCU | 1119 | AGGUCAAGGAAUCUAAAGG | 1688 |
| NM_001735.2_4952-4970_s | 4952-4970 | CCUUGACCUGGAUUGAAUA | 1120 | UAUUCAAUCCAGGUCAAGG | 1689 |
| NM_001735.2_4961-4979_s | 4961-4979 | GGAUUGAAUACUGGCCUAG | 1121 | CUAGGCCAGUAUUCAAUCC | 1690 |
| NM_001735.2_4971-4989_s | 4971-4989 | CUGGCCUAGAGACACAACA | 1122 | UGUUGUGUCUCUAGGCCAG | 1691 |
| NM_001735.2_4979-4997_s | 4979-4997 | GAGACACAACAUGUUCAUC | 1123 | GAUGAACAUGUUGUGUCUC | 1692 |
| NM_001735.2_4991-5009_s | 4991-5009 | GUUCAUCGUGUCAAGCAUU | 1124 | AAUGCUUGACACGAUGAAC | 1693 |
| NM_001735.2_5000-5018_s | 5000-5018 | GUCAAGCAUUUUUAGCUAA | 1125 | UUAGCUAAAAAUGCUUGAC | 1694 |
| NM_001735.2_5013-5031_s | 5013-5031 | AGCUAAUUUAGAUGAAUUU | 1126 | AAAUUCAUCUAAAUUAGCU | 1695 |
| NM_001735.2_5022-5040_s | 5022-5040 | AGAUGAAUUUGCCGAAGAU | 1127 | AUCUUCGGCAAAUUCAUCU | 1696 |
| NM_001735.2_5033-5051_s | 5033-5051 | CCGAAGAUAUCUUUUUAAA | 1128 | UUUAAAAAGAUAUCUUCGG | 1697 |
| NM_001735.2_5043-5061_s | 5043-5061 | CUUUUUAAAUGGAUGCUAA | 1129 | UUAGCAUCCAUUUAAAAAG | 1698 |
| NM_001735.2_5053-5071_s | 5053-5071 | GGAUGCUAAAAUUCCUGAA | 1130 | UUCAGGAAUUUUAGCAUCC | 1699 |
| NM_001735.2_5059-5077_s | 5059-5077 | UAAAAUUCCUGAAGUUCAG | 1131 | CUGAACUUCAGGAAUUUUA | 1700 |
| NM_001735.2_5071-5089_s | 5071-5089 | AGUUCAGCUGCAUACAGUU | 1132 | AACUGUAUGCAGCUGAACU | 1701 |
| NM_001735.2_5080-5098_s | 5080-5098 | GCAUACAGUUUGCACUUAU | 1133 | AUAAGUGCAAACUGUAUGC | 1702 |

TABLE 20-continued

Additional C5 unmodified sense and antisense strand sequences

| Oligo Name | Position in NM_001735.2 | Sense Sequence | SEQ ID NO: | Antisense Sequence | SEQ ID NO: |
|---|---|---|---|---|---|
| NM_001735.2_5093-5111_s | 5093-5111 | ACUUAUGGACUCCUGUUGU | 1134 | ACAACAGGAGUCCAUAAGU | 1703 |
| NM_001735.2_5099-5117_s | 5099-5117 | GGACUCCUGUUGUUGAAGU | 1135 | ACUUCAACAACAGGAGUCC | 1704 |
| NM_001735.2_5109-5127_s | 5109-5127 | UGUUGAAGUUCGUUUUUUU | 1136 | AAAAAAACGAACUUCAACA | 1705 |
| NM_001735.2_5122-5140_s | 5122-5140 | UUUUUUGUUUUCUUCUUUU | 1137 | AAAAGAAGAAAACAAAAAA | 1706 |
| NM_001735.2_5132-5150_s | 5132-5150 | UCUUCUUUUUUUAAACAUU | 1138 | AAUGUUUAAAAAAGAAGA | 1707 |
| NM_001735.2_5139-5157_s | 5139-5157 | UUUUUAAACAUUCAUAGCU | 1139 | AGCUAUGAAUGUUUAAAAA | 1708 |
| NM_001735.2_5152-5170_s | 5152-5170 | AUAGCUGGUCUUAUUUGUA | 1140 | UACAAAUAAGACCAGCUAU | 1709 |
| NM_001735.2_5159-5177_s | 5159-5177 | GUCUUAUUUGUAAAGCUCA | 1141 | UGAGCUUUACAAAUAAGAC | 1710 |
| NM_001735.2_5170-5188_s | 5170-5188 | AAAGCUCACUUUACUUAGA | 1142 | UCUAAGUAAAGUGAGCUUU | 1711 |
| NM_001735.2_5182-5200_s | 5182-5200 | ACUUAGAAUUAGUGGCACU | 1143 | AGUGCCACUAAUUCUAAGU | 1712 |
| NM_001735.2_5192-5210_s | 5192-5210 | AGUGGCACUUGCUUUUAUU | 1144 | AAUAAAAGCAAGUGCCACU | 1713 |
| NM_001735.2_5202-5220_s | 5202-5220 | GCUUUUAUUAGAGAAUGAU | 1145 | AUCAUUCUCUAAUAAAAGC | 1714 |
| NM_001735.2_5212-5230_s | 5212-5230 | GAGAAUGAUUUCAAAUGCU | 1146 | AGCAUUUGAAAUCAUUCUC | 1715 |
| NM_001735.2_5220-5238_s | 5220-5238 | UUUCAAAUGCUGUAACUUU | 1147 | AAAGUUACAGCAUUUGAAA | 1716 |
| NM_001735.2_5231-5249_s | 5231-5249 | GUAACUUUCUGAAAUAACA | 1148 | UGUUAUUUCAGAAAGUUAC | 1717 |
| NM_001735.2_5241-5259_s | 5241-5259 | GAAAUAACAUGGCCUUGGA | 1149 | UCCAAGGCCAUGUUAUUUC | 1718 |
| NM_001735.2_5253-5271_s | 5253-5271 | CCUUGGAGGGCAUGAAGAC | 1150 | GUCUUCAUGCCCUCCAAGG | 1719 |
| NM_001735.2_5259-5277_s | 5259-5277 | AGGGCAUGAAGACAGAUAC | 1151 | GUAUCUGUCUUCAUGCCCU | 1720 |
| NM_001735.2_5273-5291_s | 5273-5291 | GAUACUCCUCCAAGGUUAU | 1152 | AUAACCUUGGAGGAGUAUC | 1721 |
| NM_001735.2_5279-5297_s | 5279-5297 | CCUCCAAGGUUAUUGGACA | 1153 | UGUCCAAUAACCUUGGAGG | 1722 |
| NM_001735.2_5293-5311_s | 5293-5311 | GGACACCGGAAACAAUAAA | 1154 | UUUAUUGUUUCCGGUGUCC | 1723 |
| NM_001735.2_5301-5319_s | 5301-5319 | GAAACAAUAAAUGGAACA | 1155 | UGUUCCAUUUAUUGUUUC | 1724 |
| NM_001735.2_5311-5329_s | 5311-5329 | AUUGGAACACCUCCUCAAA | 1156 | UUUGAGGAGGUGUUCCAAU | 1725 |
| NM_001735.2_5322-5340_s | 5322-5340 | UCCUCAAACCUACCACUCA | 1157 | UGAGUGGUAGGUUUGAGGA | 1726 |
| NM_001735.2_5331-5349_s | 5331-5349 | CUACCACUCAGGAAUGUUU | 1158 | AAACAUUCCUGAGUGGUAG | 1727 |
| NM_001735.2_5343-5361_s | 5343-5361 | AAUGUUUGCUGGGGCCGAA | 1159 | UUCGGCCCCAGCAAACAUU | 1728 |
| NM_001735.2_5349-5367_s | 5349-5367 | UGCUGGGGCCGAAAGAACA | 1160 | UGUUCUUUCGGCCCCAGCA | 1729 |
| NM_001735.2_5360-5378_s | 5360-5378 | AAAGAACAGUCCAUUGAAA | 1161 | UUUCAAUGGACUGUUCUUU | 1730 |
| NM_001735.2_5371-5389_s | 5371-5389 | CAUUGAAAGGGAGUAUUAC | 1162 | GUAAUACUCCCUUUCAAUG | 1731 |
| NM_001735.2_5380-5398_s | 5380-5398 | GGAGUAUUACAAAAACAUG | 1163 | CAUGUUUUGUAAUACUCC | 1732 |
| NM_001735.2_5391-5409_s | 5391-5409 | AAAACAUGGCCUUUGCUUG | 1164 | CAAGCAAAGGCCAUGUUUU | 1733 |
| NM_001735.2_5399-5417_s | 5399-5417 | GCCUUUGCUUGAAAGAAAA | 1165 | UUUUCUUUCAAGCAAAGGC | 1734 |
| NM_001735.2_5409-5427_s | 5409-5427 | GAAAGAAAAUACCAAGGAA | 1166 | UUCCUUGGUAUUUUCUUUC | 1735 |
| NM_001735.2_5420-5438_s | 5420-5438 | CCAAGGAACAGGAAACUGA | 1167 | UCAGUUUCCUGUUCCUUGG | 1736 |
| NM_001735.2_5433-5451_s | 5433-5451 | AACUGAUCAUUAAAGCCUG | 1168 | CAGGCUUUAAUGAUCAGUU | 1737 |
| NM_001735.2_5441-5459_s | 5441-5459 | AUUAAAGCCUGAGUUUGCU | 1169 | AGCAAACUCAGGCUUUAAU | 1738 |

Example 5

In Vivo C5 Silencing

Figure 13:
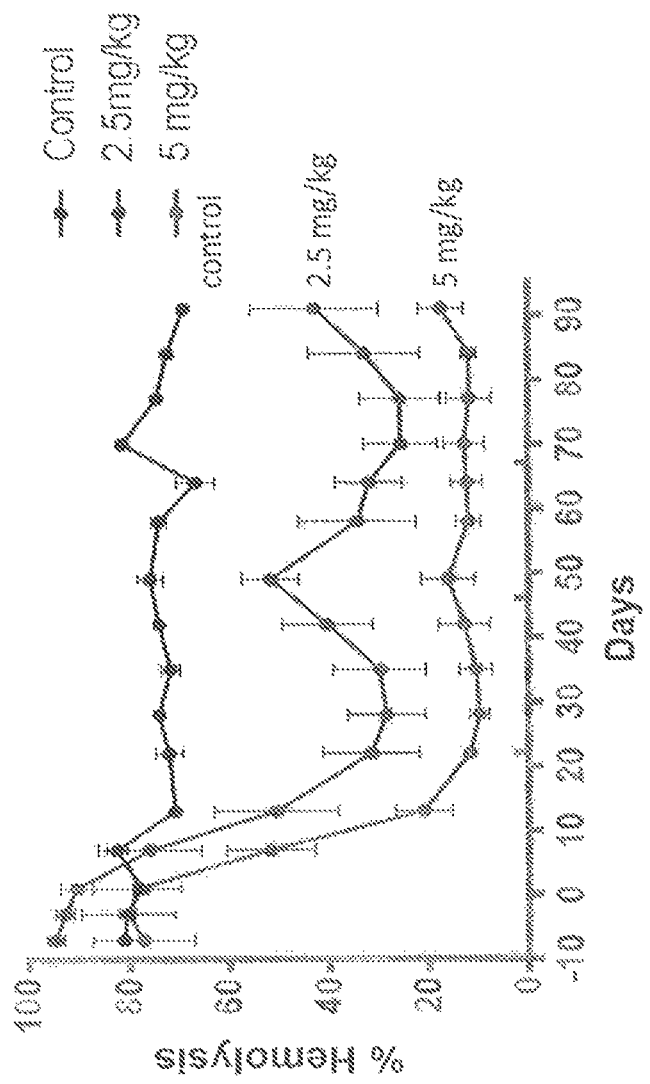
FIG. 13 is a graph showing the percentage of hemolysis remaining in cynomolgus macaque serum at various time points before, during and after two rounds of subcutaneous dosing at 2.5 mg/kg or 5 mg/kg of AD-58641 every third day for eight doses. Percent hemolysis was calculated relative to maximal hemolysis and to background hemolysis in control samples.

Groups of three female cynomolgus macaques were treated with C5-siRNA AD-58641 subcutaneously in the scapular and mid-dorsal areas of the back at 2.5 mg/kg or 5 mg/kg doses or a vehicle control. Two rounds of dosing were administered with eight doses in each round given every third day. Serum C5 was collected and evaluated using an ELISA assay specific for C5 detection (Abcam) at the indicated time points (FIG. 13). C5 levels were normalized to the average of three pre-dose samples. Samples collected prior to dosing, and on day 23 (24 hours after the last dose administered in the first round of treatment) were analyzed by complete serum chemistry, hematology and coagulation panels.

Figure 12:
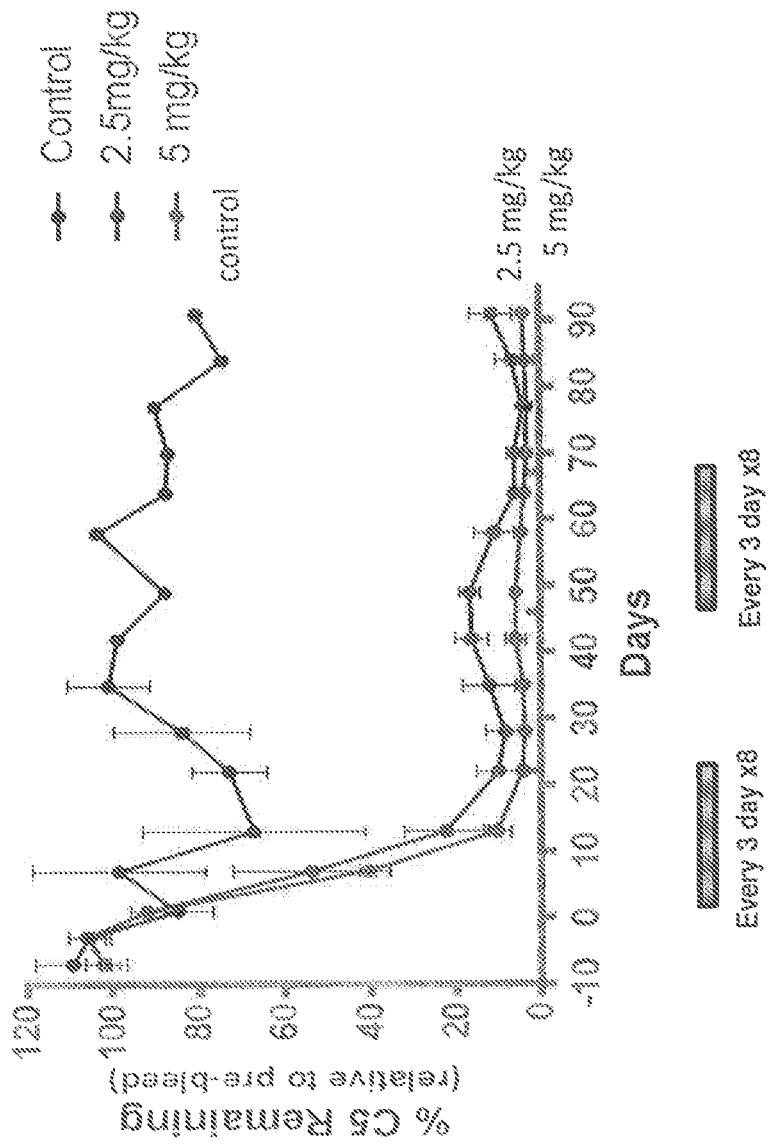
FIG. 12 is a graph showing the amount of complement component C5 protein in cynomolgus macaque serum at various time points before, during and after two rounds of subcutaneous dosing at 2.5 mg/kg or 5 mg/kg of AD-58641 every third day for eight doses. C5 protein levels were normalized to the average of the three pre-dose samples.

Analysis of serum C5 protein levels relative to pre-treatment serum C5 protein levels demonstrated that the 5 mg/kg AD-58641 dosing regimen reduced serum C5 protein levels up to 98% (FIG. 12). The average serum C5 levels were reduced by 97% at the nadir, indicating that the majority of circulating C5 is hepatic in origin. There was potent, dose-dependent and durable knock-down of serum C5 protein levels with subcutaneous administration of AD-58641. No changes in hematology, serum chemistry or coagulation parameters were identified 24 hours after the first round of dosing.

Serum hemolytic activity was also analyzed using a sensitized sheep erythrocyte assay to measure classical pathway activity. The percent hemolysis was calculated relative to maximal hemolysis and to background hemolysis in control samples. Mean hemolysis values+/−the SEM for three animals were calculated and analyzed (FIG. 13). Hemolysis was reduced up to 94% in the 5 mg/kg dosing regimen with an average inhibition of 92% at the nadir. The reduction in hemolysis was maintained for greater than two weeks following the last dose.

Example 6

In Vitro Screening of Additional siRNAs

The C5 sense and antisense strand sequences shown in Table 20 were modified at the 3'-terminus with a short sequence of deoxy-thymine nucleotides (dT) (Table 21). The in vitro efficacy of duplexes comprising the sense and antisense sequences listed in Table 21 was determined using the following methods.

Cell Culture and Transfections

Hep3B cells (ATCC, Manassas, Va.) were grown to near confluence at 37° C. in an atmosphere of 5% $CO_2$ in EMEM (ATCC) supplemented with 10% FBS, before being released from the plate by trypsinization. Transfection was carried out by adding 5 µl of Opti-MEM plus 0.1 µl of Lipofectamine RNAiMax per well (Invitrogen, Carlsbad Calif. cat #13778-150) to 5 µl of siRNA duplexes per well into a 384-well plate and incubated at room temperature for 15 minutes. 40 µl of complete growth media containing ~5×10$^3$ Hep3B cells were then added to the siRNA mixture. Cells were incubated for 24 hours prior to RNA purification. Experiments were performed at 10 nM final duplex concentration.

Total RNA Isolation Using DYNABEADS mRNA Isolation Kit (Invitrogen, Part #: 610-12)

RNA isolation was performed using a semi-automated process of a Biotek EL 405 washer. Briefly, cells were lysed in 75 µl of Lysis/Binding Buffer containing 2 ul of Dynabeads, then mixed for 10 minutes on setting 7 of an electromagnetic shaker (Union Scientific). Magnetic beads were captured using magnetic stand and the supernatant was removed. After removing supernatant, magnetic beads were washed with 90 µl Wash Buffer A, followed by 90 µl of Wash buffer B. Beads were then washed twice with 100 ul of Elution buffer which was then aspirated and cDNA generated directly on bead bound RNA in the 384 well plate.

cDNA Synthesis Using ABI High Capacity cDNA Reverse Transcription Kit (Applied Biosystems, Foster City, Calif., Cat #4368813)

A master mix of 2 µl 10× Buffer, 0.8 µl 25×dNTPs, 2 µl Random primers, 1 µl Reverse Transcriptase, 1 µl RNase inhibitor and 3.2 µl of $H_2O$ per reaction were added directly to the bead bound RNA in the 384 well plates used for RNA isolation. Plates were then shaken on an electromagnetic shaker for 10 minutes and then placed in a 37° C. incubator for 2 hours. Following this incubation, plates were place on a shake in an 80° C. incubator for 7 minutes to inactivate the enzyme and elute the RNA/cDNA from the beads.

Real Time PCR

2 µl of cDNA were added to a master mix containing 0.5 µl GAPDH TaqMan Probe (Applied Biosystems Cat #4326317E), 0.5 µl C5 TaqMan probe (Applied Biosystems cat #Hs00156197_M1) and 5 µl Lightcycler 480 probe master mix (Roche Cat #04887301001) per well in a 384 well plates (Roche cat #04887301001). Real time PCR was done in a Roche LC480 Real Time PCR system (Roche). Each duplex was tested in at least two independent transfections and each transfection was assayed in duplicate.

To calculate relative fold change, real time data were analyzed using the ΔΔCt method and normalized to assays performed with cells transfected with 10 nM AD-1955, or mock transfected cells.

Table 22 shows the results of a single dose screen in Hep3B cells transfected with the indicated dT modified iRNAs. Data are expressed as percent of message remaining relative to untreated cells.

TABLE 21 dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-61779.2 | UAUCCGUGGUUUCCUGCUAdTdT | 1739 | 3-21 | UAGCAGGAAACCACGGAUAdTdT | 2306 |
| AD-61785.2 | GGUUUCCUGCUACCUCCAAdTdT | 1740 | 10-28 | UUGGAGGUAGCAGGAAACCdTdT | 2307 |
| AD-61791.2 | CCUCCAACCAUGGGCCUUUdTdT | 1741 | 22-40 | AAAGGCCCAUGGUUGGAGGdTdT | 2308 |
| AD-61797.2 | GGGCCUUUUGGGAAUACUUdTdT | 1742 | 33-51 | AAGUAUUCCCAAAAGGCCCdTdT | 2309 |
| AD-61803.2 | GGAAUACUUUGUUUUUUAAdTdT | 1743 | 43-61 | UUAAAAAACAAAGUAUUCCdTdT | 2310 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-61809.2 | CUUUGUUUUUAAUCUUCCdTdT | 1744 | 49-67 | GGAAGAUUAAAAAACAAAGdTdT | 2311 |
| AD-61815.2 | CUUCCUGGGGAAAACCUGGdTdT | 1745 | 63-81 | CCAGGUUUUCCCCAGGAAGdTdT | 2312 |
| AD-61821.2 | GGAAAACCUGGGGACAGGAdTdT | 1746 | 71-89 | UCCUGUCCCCAGGUUUUCCdTdT | 2313 |
| AD-61780.2 | GGGACAGGAGCAAACAUAUdTdT | 1747 | 81-99 | AUAUGUUUGCUCCUGUCCCdTdT | 2314 |
| AD-61786.2 | CAAACAUAUGUCAUUUCAGdTdT | 1748 | 91-109 | CUGAAAUGACAUAUGUUUGdTdT | 2315 |
| AD-61792.2 | CAUUUCAGCACCAAAAAUAdTdT | 1749 | 102-120 | UAUUUUUGGUGCUGAAAUGdTdT | 2316 |
| AD-61798.2 | GCACCAAAAAUAUUCCGUGdTdT | 1750 | 109-127 | CACGGAAUAUUUUUGGUGCdTdT | 2317 |
| AD-61804.2 | CCGUGUUGGAGCAUCUGAAdTdT | 1751 | 123-141 | UUCAGAUGCUCCAACACGGdTdT | 2318 |
| AD-61810.2 | GGAGCAUCUGAAAAUAUUGdTdT | 1752 | 130-148 | CAAUAUUUUCAGAUGCUCCdTdT | 2319 |
| AD-61816.2 | GAAAAUAUUGUGAUUCAAGdTdT | 1753 | 139-157 | CUUGAAUCACAAUAUUUUCdTdT | 2320 |
| AD-61822.2 | GAUUCAAGUUUAUGGAUACdTdT | 1754 | 150-168 | GUAUCCAUAAACUUGAAUCdTdT | 2321 |
| AD-61781.2 | GGAUACACUGAAGCAUUUGdTdT | 1755 | 163-181 | CAAAUGCUUCAGUGUAUCCdTdT | 2322 |
| AD-61787.2 | GAAGCAUUUGAUGCAACAAdTdT | 1756 | 172-190 | UUGUUGCAUCAAAUGCUUCdTdT | 2323 |
| AD-61793.2 | UGCAACAAUCUCUAUUAAAdTdT | 1757 | 183-201 | UUUAAUAGAGAUUGUUGCAdTdT | 2324 |
| AD-61799.2 | AAUCUCUAUUAAAGUUAUdTdT | 1758 | 189-207 | AUAACUUUUAAUAGAGAUUdTdT | 2325 |
| AD-61805.2 | AAGUUAUCCUGAUAAAAAAdTdT | 1759 | 201-219 | UUUUUUAUCAGGAUAACUUdTdT | 2326 |
| AD-61811.2 | CUGAUAAAAAAUUUAGUUAdTdT | 1760 | 209-227 | UAACUAAAUUUUUAUCAGdTdT | 2327 |
| AD-61817.2 | UUAGUUACUCCUCAGGCCAdTdT | 1761 | 221-239 | UGGCCUGAGGAGUAACUAAdTdT | 2328 |
| AD-61823.2 | CCUCAGGCCAUGUUCAUUUdTdT | 1762 | 230-248 | AAAUGAACAUGGCCUGAGGdTdT | 2329 |
| AD-61782.2 | UUCAUUUAUCCUCAGAGAAdTdT | 1763 | 242-260 | UUCUCUGAGGAUAAAUGAAdTdT | 2330 |
| AD-61788.2 | CUCAGAGAAUAAAUUCCAAdTdT | 1764 | 252-270 | UUGGAAUUUAUUCUCUGAGdTdT | 2331 |
| AD-61794.2 | AAUAAAUUCCAAAACUCUGdTdT | 1765 | 259-277 | CAGAGUUUUGGAAUUUAUUdTdT | 2332 |
| AD-61800.2 | CUCUGCAAUCUUAACAAUAdTdT | 1766 | 273-291 | UAUUGUUAAGAUUGCAGAGdTdT | 2333 |
| AD-61806.2 | CUUAACAAUACAACCAAAAdTdT | 1767 | 282-300 | UUUUGGUUGUAUUGUUAAGdTdT | 2334 |
| AD-61812.2 | CAACCAAAACAAUUGCCUGdTdT | 1768 | 292-310 | CAGGCAAUUGUUUUGGUUGdTdT | 2335 |
| AD-61818.2 | CAAUUGCCUGGAGGACAAAdTdT | 1769 | 301-319 | UUUGUCCUCCAGGCAAUUGdTdT | 2336 |
| AD-61824.2 | GGACAAAACCCAGUUUCUUdTdT | 1770 | 313-331 | AAGAAACUGGGUUUUGUCCdTdT | 2337 |
| AD-61783.2 | CCAGUUUCUUAUGUGUAUUdTdT | 1771 | 322-340 | AAUACACAUAAGAAACUGGdTdT | 2338 |
| AD-61789.2 | AUGUGUAUUUGGAAGUUGUdTdT | 1772 | 332-350 | ACAACUUCCAAAUACACAUdTdT | 2339 |
| AD-61795.2 | GGAAGUUGUAUCAAAGCAUdTdT | 1773 | 342-360 | AUGCUUUGAUACAACUUCCdTdT | 2340 |
| AD-61801.2 | GUAUCAAAGCAUUUUUCAAdTdT | 1774 | 349-367 | UUGAAAAAUGCUUUGAUACdTdT | 2341 |
| AD-61807.2 | UUUUCAAAAUCAAAAAGAAdTdT | 1775 | 361-379 | UUCUUUUUGAUUUUGAAAAdTdT | 2342 |
| AD-61813.2 | CAAAAAGAAUGCCAAUAACdTdT | 1776 | 371-389 | GUUAUUGGCAUUCUUUUUGdTdT | 2343 |
| AD-61819.2 | GCCAAUAACCUAUGACAAUdTdT | 1777 | 381-399 | AUUGUCAUAGGUUAUUGGCdTdT | 2344 |
| AD-61825.2 | CCUAUGACAAUGGAUUUCUdTdT | 1778 | 389-407 | AGAAAUCCAUUGUCAUAGGdTdT | 2345 |
| AD-61784.2 | UGGAUUUCUCUUCAUUCAUdTdT | 1779 | 399-417 | AUGAAUGAAGAGAAAUCCAdTdT | 2346 |
| AD-61790.2 | CAUUCAUACAGACAAACCUdTdT | 1780 | 411-429 | AGGUUUGUCUGUAUGAAUGdTdT | 2347 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-61796.2 | CAGACAAACCUGUUUAUACdTdT | 1781 | 419-437 | GUAUAAACAGGUUUGUCUGdTdT | 2348 |
| AD-61802.2 | GUUUAUACUCCAGACCAGUdTdT | 1782 | 430-448 | ACUGGUCUGGAGUAUAAACdTdT | 2349 |
| AD-61808.2 | AGACCAGUCAGUAAAAGUUdTdT | 1783 | 441-459 | AACUUUUACUGACUGGUCUdTdT | 2350 |
| AD-61814.2 | AGUAAAAGUUAGAGUUUAUdTdT | 1784 | 450-468 | AUAAACUCUAACUUUUACUdTdT | 2351 |
| AD-61820.2 | AGAGUUUAUUCGUUGAAUGdTdT | 1785 | 460-478 | CAUUCAACGAAUAAACUCUdTdT | 2352 |
| AD-61826.2 | CGUUGAAUGACGACUUGAAdTdT | 1786 | 470-488 | UUCAAGUCGUCAUUCAACGdTdT | 2353 |
| AD-61832.2 | CUUGAAGCCAGCCAAAAGAdTdT | 1787 | 483-501 | UCUUUUGGCUGGCUUCAAGdTdT | 2354 |
| AD-61838.2 | CCAGCCAAAAGAGAAACUGdTdT | 1788 | 490-508 | CAGUUUCUCUUUUGGCUGGdTdT | 2355 |
| AD-61844.2 | AAACUGUCUUAACUUUCAUdTdT | 1789 | 503-521 | AUGAAAGUUAAGACAGUUUdTdT | 2356 |
| AD-61850.2 | AACUUUCAUAGAUCCUGAAdTdT | 1790 | 513-531 | UUCAGGAUCUAUGAAAGUUdTdT | 2357 |
| AD-61856.2 | CAUAGAUCCUGAAGGAUCAdTdT | 1791 | 519-537 | UGAUCCUUCAGGAUCUAUGdTdT | 2358 |
| AD-61862.2 | GAAGGAUCAGAAGUUGACAdTdT | 1792 | 529-547 | UGUCAACUUCUGAUCCUUCdTdT | 2359 |
| AD-61868.2 | UGACAUGGUAGAAGAAAUUdTdT | 1793 | 543-561 | AAUUUCUUCUACCAUGUCAdTdT | 2360 |
| AD-61827.2 | GAAGAAAUUGAUCAUAUUGdTdT | 1794 | 553-571 | CAAUAUGAUCAAUUUCUUCdTdT | 2361 |
| AD-61833.2 | GAUCAUAUUGGAAUUAUCUdTdT | 1795 | 562-580 | AGAUAAUUCCAAUAUGAUCdTdT | 2362 |
| AD-61839.2 | GGAAUUAUCUCUUUUCCUGdTdT | 1796 | 571-589 | CAGGAAAAGAGAUAAUUCCdTdT | 2363 |
| AD-61845.2 | CUCUUUUCCUGACUUCAAGdTdT | 1797 | 579-597 | CUUGAAGUCAGGAAAAGAGdTdT | 2364 |
| AD-61851.2 | ACUUCAAGAUUCCGUCUAAdTdT | 1798 | 590-608 | UUAGACGGAAUCUUGAAGUdTdT | 2365 |
| AD-61857.2 | CCGUCUAAUCCUAGAUAUGdTdT | 1799 | 601-619 | CAUAUCUAGGAUUAGACGGdTdT | 2366 |
| AD-61863.2 | CCUAGAUAUGGUAUGUGGAdTdT | 1800 | 610-628 | UCCACAUACCAUAUCUAGGdTdT | 2367 |
| AD-61869.2 | UGUGGACGAUCAAGGCUAAdTdT | 1801 | 623-641 | UUAGCCUUGAUCGUCCACAdTdT | 2368 |
| AD-61828.2 | CGAUCAAGGCUAAAUAUAAdTdT | 1802 | 629-647 | UUAUAUUUAGCCUUGAUCGdTdT | 2369 |
| AD-61834.2 | AUAUAAAGAGGACUUUUCAdTdT | 1803 | 642-660 | UGAAAAGUCCUCUUUAUAUdTdT | 2370 |
| AD-61840.2 | GAGGACUUUUCAACAACUGdTdT | 1804 | 649-667 | CAGUUGUUGAAAAGUCCUCdTdT | 2371 |
| AD-61846.2 | CAACUGGAACCGCAUAUUUdTdT | 1805 | 662-680 | AAAUAUGCGGUUCCAGUUGdTdT | 2372 |
| AD-61852.2 | CGCAUAUUUUGAAGUUAAAdTdT | 1806 | 672-690 | UUUAACUUCAAAAUAUGCGdTdT | 2373 |
| AD-61858.2 | AAGUUAAAGAAUAUGUCUUdTdT | 1807 | 683-701 | AAGACAUAUUCUUUAACUUdTdT | 2374 |
| AD-61864.2 | GAAUAUGUCUUGCCACAUUdTdT | 1808 | 691-709 | AAUGUGGCAAGACAUAUUCdTdT | 2375 |
| AD-61870.2 | CCACAUUUUUCUGUCUCAAdTdT | 1809 | 703-721 | UUGAGACAGAAAAAUGUGGdTdT | 2376 |
| AD-61829.2 | CUGUCUCAAUCGAGCCAGAdTdT | 1810 | 713-731 | UCUGGCUCGAUUGAGACAGdTdT | 2377 |
| AD-61835.2 | CAAUCGAGCCAGAAUAUAAdTdT | 1811 | 719-737 | UUAUAUUCUGGCUCGAUUGdTdT | 2378 |
| AD-61841.2 | GAAUAUAAUUUCAUUGGUUdTdT | 1812 | 730-748 | AACCAAUGAAAUUAUAUUCdTdT | 2379 |
| AD-61847.2 | AUUGGUUACAAGAACUUUAdTdT | 1813 | 742-760 | UAAAGUUCUUGUAACCAAUdTdT | 2380 |
| AD-61853.2 | AGAACUUUAAGAAUUUUGAdTdT | 1814 | 752-770 | UCAAAAUUCUUAAAGUUCUdTdT | 2381 |
| AD-61859.2 | GAAUUUUGAAAUUACUAUAdTdT | 1815 | 762-780 | UAUAGUAAUUUCAAAAUUCdTdT | 2382 |
| AD-61865.2 | GAAAUUACUAUAAAAGCAAdTdT | 1816 | 769-787 | UUGCUUUUAUAGUAAUUUCdTdT | 2383 |
| AD-61871.2 | AAAGCAAGAUAUUUUUAUAdTdT | 1817 | 781-799 | UAUAAAAAUAUCUUGCUUUdTdT | 2384 |
| AD-61830.2 | AUAUUUUUAUAAUAAAGUAdTdT | 1818 | 789-807 | UACUUUAUUAUAAAAAUAUdTdT | 2385 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-61836.2 | AAGUAGUCACUGAGGCUGAdTdT | 1819 | 803-821 | UCAGCCUCAGUGACUACUUdTdT | 2386 |
| AD-61842.2 | CACUGAGGCUGACGUUUAUdTdT | 1820 | 810-828 | AUAAACGUCAGCCUCAGUGdTdT | 2387 |
| AD-61848.2 | CGUUUAUAUCACAUUUGGAdTdT | 1821 | 822-840 | UCCAAAUGUGAUAUAAACGdTdT | 2388 |
| AD-61854.2 | CACAUUUGGAAUAAGAGAAdTdT | 1822 | 831-849 | UUCUCUUAUUCCAAAUGUGdTdT | 2389 |
| AD-61860.2 | AAUAAGAGAAGACUUAAAAdTdT | 1823 | 840-858 | UUUUAAGUCUUCUCUUAUUdTdT | 2390 |
| AD-61866.2 | CUUAAAAGAUGAUCAAAAAdTdT | 1824 | 852-870 | UUUUUGAUCAUCUUUUAAGdTdT | 2391 |
| AD-61872.2 | GAUGAUCAAAAAGAAAUGAdTdT | 1825 | 859-877 | UCAUUUCUUUUUGAUCAUCdTdT | 2392 |
| AD-61831.2 | AAAUGAUGCAAACAGCAAUdTdT | 1826 | 872-890 | AUUGCUGUUUGCAUCAUUUdTdT | 2393 |
| AD-61837.2 | ACAGCAAUGCAAAACACAAdTdT | 1827 | 883-901 | UUGUGUUUUGCAUUGCUGUdTdT | 2394 |
| AD-61843.2 | AAAACACAAUGUUGAUAAAdTdT | 1828 | 893-911 | UUUAUCAACAUUGUGUUUUdTdT | 2395 |
| AD-61849.2 | CAAUGUUGAUAAAUGGAAUdTdT | 1829 | 899-917 | AUUCCAUUUAUCAACAUUGdTdT | 2396 |
| AD-61855.2 | GGAAUUGCUCAAGUCACAUdTdT | 1830 | 913-931 | AUGUGACUUGAGCAAUUCCdTdT | 2397 |
| AD-61861.2 | GCUCAAGUCACAUUUGAUUdTdT | 1831 | 919-937 | AAUCAAAUGUGACUUGAGCdTdT | 2398 |
| AD-61867.2 | AUUUGAUUCUGAAACAGCAdTdT | 1832 | 930-948 | UGCUGUUUCAGAAUCAAAUdTdT | 2399 |
| AD-62062.1 | UGAAACAGCAGUCAAAGAAdTdT | 1833 | 939-957 | UUCUUUGACUGCUGUUUCAdTdT | 2400 |
| AD-62068.1 | CAAAGAACUGUCAUACUACdTdT | 1834 | 951-969 | GUAGUAUGACAGUUCUUUGdTdT | 2401 |
| AD-62074.1 | CAUACUACAGUUUAGAAGAdTdT | 1835 | 962-980 | UCUUCUAAACUGUAGUAUGdTdT | 2402 |
| AD-62080.1 | CAGUUUAGAAGAUUUAAACdTdT | 1836 | 969-987 | GUUUAAAUCUUCUAAACUGdTdT | 2403 |
| AD-62086.1 | UAAACAACAAGUACCUUUAdTdT | 1837 | 983-1001 | UAAAGGUACUUGUUGUUUAdTdT | 2404 |
| AD-62092.1 | CAAGUACCUUUAUAUUGCUdTdT | 1838 | 990-1008 | AGCAAUAUAAAGGUACUUGdTdT | 2405 |
| AD-62098.1 | UAUUGCUGUAACAGUCAUAdTdT | 1839 | 1002-1020 | UAUGACUGUUACAGCAAUAdTdT | 2406 |
| AD-62104.1 | AACAGUCAUAGAGUCUACAdTdT | 1840 | 1011-1029 | UGUAGACUCUAUGACUGUUdTdT | 2407 |
| AD-62063.1 | AGAGUCUACAGGUGGAUUUdTdT | 1841 | 1020-1038 | AAAUCCACCUGUAGACUCUdTdT | 2408 |
| AD-62069.1 | GGAUUUUCUGAAGAGGCAGdTdT | 1842 | 1033-1051 | CUGCCUCUUCAGAAAAUCCdTdT | 2409 |
| AD-62075.1 | GAAGAGGCAGAAAUACCUGdTdT | 1843 | 1042-1060 | CAGGUAUUUCUGCCUCUUCdTdT | 2410 |
| AD-62081.1 | AGAAAUACCUGGCAUCAAAdTdT | 1844 | 1050-1068 | UUUGAUGCCAGGUAUUUCUdTdT | 2411 |
| AD-62087.1 | GCAUCAAAUAUGUCCUCUCdTdT | 1845 | 1061-1079 | GAGAGGACAUAUUUGAUGCdTdT | 2412 |
| AD-62093.1 | UGUCCUCUCUCCCUACAAAdTdT | 1846 | 1071-1089 | UUUGUAGGGAGAGAGGACAdTdT | 2413 |
| AD-62099.1 | GAAUUGGUUGCUACUCCUdTdT | 1847 | 1092-1110 | AGGAGUAGCAACCAAUUCdTdT | 2414 |
| AD-62105.1 | GCUACUCCUCUUUUCCUGAdTdT | 1848 | 1102-1120 | UCAGGAAAAGAGGAGUAGCdTdT | 2415 |
| AD-62064.1 | CUCUUUUCCUGAAGCCUGGdTdT | 1849 | 1109-1127 | CCAGGCUUCAGGAAAAGAGdTdT | 2416 |
| AD-62070.1 | CCUGGGAUUCCAUAUCCCAdTdT | 1850 | 1123-1141 | UGGGAUAUGGAAUCCCAGGdTdT | 2417 |
| AD-62076.1 | CAUAUCCCAUCAAGGUGCAdTdT | 1851 | 1133-1151 | UGCACCUUGAUGGGAUAUGdTdT | 2418 |
| AD-62082.1 | CCAUCAAGGUGCAGGUUAAdTdT | 1852 | 1139-1157 | UUAACCUGCACCUUGAUGGdTdT | 2419 |
| AD-62088.1 | CAGGUUAAAGAUUCGCUUGdTdT | 1853 | 1150-1168 | CAAGCGAAUCUUUAACCUGdTdT | 2420 |
| AD-62094.1 | UUCGCUUGACCAGUUGGUAdTdT | 1854 | 1161-1179 | UACCAACUGGUCAAGCGAAdTdT | 2421 |
| AD-62100.1 | CCAGUUGGUAGGAGGAGUCdTdT | 1855 | 1170-1188 | GACUCCUCCUACCAACUGGdTdT | 2422 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-62106.1 | GGAGGAGUCCCAGUAACACdTdT | 1856 | 1180-1198 | GUGUUACUGGGACUCCUCCdTdT | 2423 |
| AD-62065.1 | CAGUAACACUGAAUGCACdTdT | 1857 | 1190-1208 | UGUGCAUUCAGUGUUACUGdTdT | 2424 |
| AD-62071.1 | GAAUGCACAAACAAUUGAUdTdT | 1858 | 1200-1218 | AUCAAUUGUUUGUGCAUUCdTdT | 2425 |
| AD-62077.1 | AACAAUUGAUGUAAACCAAdTdT | 1859 | 1209-1227 | UUGGUUUACAUCAAUUGUUdTdT | 2426 |
| AD-62083.1 | UAAACCAAGAGACAUCUGAdTdT | 1860 | 1220-1238 | UCAGAUGUCUCUUGGUUUAdTdT | 2427 |
| AD-62089.1 | CAUCUGACUUGGAUCCAAGdTdT | 1861 | 1232-1250 | CUUGGAUCCAAGUCAGAUGdTdT | 2428 |
| AD-62095.1 | GAUCCAAGCAAAAGUGUAAdTdT | 1862 | 1243-1261 | UUACACUUUUGCUUGGAUCdTdT | 2429 |
| AD-62101.1 | CAAAAGUGUAACACGUGUUdTdT | 1863 | 1251-1269 | AACACGUGUUACACUUUUGdTdT | 2430 |
| AD-62107.1 | AACACGUGUUGAUGAUGGAdTdT | 1864 | 1260-1278 | UCCAUCAUCAACACGUGUUdTdT | 2431 |
| AD-62066.1 | UGAUGGAGUAGCUUCCUUUdTdT | 1865 | 1272-1290 | AAAGGAAGCUACUCCAUCAdTdT | 2432 |
| AD-62072.1 | GUAGCUUCCUUUGUGCUUAdTdT | 1866 | 1279-1297 | UAAGCACAAAGGAAGCUACdTdT | 2433 |
| AD-62078.1 | GCUUAAUCUCCCAUCUGGAdTdT | 1867 | 1293-1311 | UCCAGAUGGGAGAUUAAGCdTdT | 2434 |
| AD-62084.1 | CCAUCUGGAGUGACGGUGCdTdT | 1868 | 1303-1321 | GCACCGUCACUCCAGAUGGdTdT | 2435 |
| AD-62090.1 | UGACGGUGCUGGAGUUUAAdTdT | 1869 | 1313-1331 | UUAAACUCCAGCACCGUCAdTdT | 2436 |
| AD-62096.1 | GCUGGAGUUUAAUGUCAAAdTdT | 1870 | 1320-1338 | UUUGACAUUAAACUCCAGCdTdT | 2437 |
| AD-62102.1 | UGUCAAAACUGAUGCUCCAdTdT | 1871 | 1332-1350 | UGGAGCAUCAGUUUUGACAdTdT | 2438 |
| AD-62108.1 | GAUGCUCCAGAUCUUCCAGdTdT | 1872 | 1342-1360 | CUGGAAGAUCUGGAGCAUCdTdT | 2439 |
| AD-62067.1 | CAGAUCUUCCAGAAGAAAAdTdT | 1873 | 1349-1367 | UUUUCUUCUGGAAGAUCUGdTdT | 2440 |
| AD-62073.1 | AGAAAAUCAGGCCAGGGAAdTdT | 1874 | 1362-1380 | UUCCCUGGCCUGAUUUUCUdTdT | 2441 |
| AD-62079.1 | GGCCAGGGAAGGUUACCGAdTdT | 1875 | 1371-1389 | UCGGUAACCUUCCCUGGCCdTdT | 2442 |
| AD-62085.1 | GUUACCGAGCAAUAGCAUAdTdT | 1876 | 1382-1400 | UAUGCUAUUGCUCGGUAACdTdT | 2443 |
| AD-62091.1 | AUAGCAUACUCAUCUCUCAdTdT | 1877 | 1393-1411 | UGAGAGAUGAGUAUGCUAUdTdT | 2444 |
| AD-62097.1 | UACUCAUCUCUCAGCCAAAdTdT | 1878 | 1399-1417 | UUUGGCUGAGAGAUGAGUAdTdT | 2445 |
| AD-62103.1 | GCCAAAGUUACCUUUAUAUdTdT | 1879 | 1412-1430 | AUAUAAAGGUAACUUUGGCdTdT | 2446 |
| AD-62109.1 | CCUUUAUAUUGAUUGGACUdTdT | 1880 | 1422-1440 | AGUCCAAUCAAUAUAAAGGdTdT | 2447 |
| AD-62115.1 | GAUUGGACUGAUAACCAUAdTdT | 1881 | 1432-1450 | UAUGGUUAUCAGUCCAAUCdTdT | 2448 |
| AD-62121.1 | CUGAUAACCAUAAGGCUUUdTdT | 1882 | 1439-1457 | AAAGCCUUAUGGUUAUCAGdTdT | 2449 |
| AD-62127.1 | AGGCUUUGCUAGUGGGAGAdTdT | 1883 | 1451-1469 | UCUCCCACUAGCAAAGCCUdTdT | 2450 |
| AD-62133.1 | GUGGGAGAACAUCUGAAUAdTdT | 1884 | 1462-1480 | UAUUCAGAUGUUCUCCCACdTdT | 2451 |
| AD-62139.1 | CAUCUGAAUAUUAUUGUUAdTdT | 1885 | 1471-1489 | UAACAAUAAUAUUCAGAUGdTdT | 2452 |
| AD-62145.1 | UAUUAUUGUUACCCCCAAAdTdT | 1886 | 1479-1497 | UUUGGGGGUAACAAUAAUAdTdT | 2453 |
| AD-62151.1 | CCCAAAGCCCAUAUAUUGdTdT | 1887 | 1492-1510 | CAAUAUAUGGGCUUUUGGGdTdT | 2454 |
| AD-62110.1 | CCAAAGCCCAUAUAUUGAdTdT | 1888 | 1493-1511 | UCAAUAUAUGGGCUUUUGGdTdT | 2455 |
| AD-62116.1 | CAAAGCCCAUAUAUUGACdTdT | 1889 | 1494-1512 | GUCAAUAUAUGGGCUUUUGdTdT | 2456 |
| AD-62122.1 | AAAGCCCAUAUAUUGACAdTdT | 1890 | 1495-1513 | UGUCAAUAUAUGGGCUUUUdTdT | 2457 |
| AD-62128.1 | AAGCCCAUAUAUUGACAAdTdT | 1891 | 1496-1514 | UUGUCAAUAUAUGGGCUUUdTdT | 2458 |
| AD-62134.1 | AGCCCAUAUAUUGACAAAdTdT | 1892 | 1497-1515 | UUUGUCAAUAUAUGGGCUUdTdT | 2459 |
| AD-62140.1 | AGCCCAUAUAUUGACAAAAdTdT | 1893 | 1498-1516 | UUUUGUCAAUAUAUGGGCUdTdT | 2460 |

TABLE 21-continued dT Modified C5 iRNAs

| Duplex ID | Sense Sequence | SEQ ID NO: | Position in NM_001735.2 | Antisense Sequence | SEQ ID NO: |
| --- | --- | --- | --- | --- | --- |
| AD-62146.1 | GCCCAUAUAUUGACAAAAUdTdT | 1894 | 1499-1517 | AUUUUGUCAAUAUAUGGGCdTdT | 2461 |
| AD-62152.1 | CCCAUAUAUUGACAAAAUAdTdT | 1895 | 1500-1518 | UAUUUUGUCAAUAUAUGGGdTdT | 2462 |
| AD-62111.1 | CCAUAUAUUGACAAAAUAAdTdT | 1896 | 1501-1519 | UUAUUUUGUCAAUAUAUGGdTdT | 2463 |
| AD-62117.1 | CAUAUAUUGACAAAAUAACdTdT | 1897 | 1502-1520 | GUUAUUUUGUCAAUAUAUGdTdT | 2464 |
| AD-62123.1 | AUAUAUUGACAAAAUAACUdTdT | 1898 | 1503-1521 | AGUUAUUUUGUCAAUAUAUdTdT | 2465 |
| AD-62129.1 | UAUAUUGACAAAAUAACUCdTdT | 1899 | 1504-1522 | GAGUUAUUUUGUCAAUAUAdTdT | 2466 |
| AD-62135.1 | AUAUUGACAAAAUAACUCAdTdT | 1900 | 1505-1523 | UGAGUUAUUUUGUCAAUAUdTdT | 2467 |
| AD-62141.1 | UAUUGACAAAAUAACUCACdTdT | 1901 | 1506-1524 | GUGAGUUAUUUUGUCAAUAdTdT | 2468 |
| AD-62147.1 | AUUGACAAAAUAACUCACUdTdT | 1902 | 1507-1525 | AGUGAGUUAUUUUGUCAAUdTdT | 2469 |
| AD-62153.1 | UUGACAAAAUAACUCACUAdTdT | 1903 | 1508-1526 | UAGUGAGUUAUUUUGUCAAdTdT | 2470 |
| AD-62112.1 | UGACAAAAUAACUCACUAUdTdT | 1904 | 1509-1527 | AUAGUGAGUUAUUUUGUCAdTdT | 2471 |
| AD-62118.1 | GACAAAAUAACUCACUAUAdTdT | 1905 | 1510-1528 | UAUAGUGAGUUAUUUUGUCdTdT | 2472 |
| AD-62124.1 | AAAUAACUCACUAUAAUUdTdT | 1906 | 1513-1531 | AAUUAUAGUGAGUUAUUUUdTdT | 2473 |
| AD-62130.1 | AAAUAACUCACUAUAAUUAdTdT | 1907 | 1514-1532 | UAAUUAUAGUGAGUUAUUUdTdT | 2474 |
| AD-62136.1 | AAUAACUCACUAUAAUUACdTdT | 1908 | 1515-1533 | GUAAUUAUAGUGAGUUAUUdTdT | 2475 |
| AD-62142.1 | AUAACUCACUAUAAUUACUdTdT | 1909 | 1516-1534 | AGUAAUUAUAGUGAGUUAUdTdT | 2476 |
| AD-62148.1 | AACUCACUAUAAUUACUUGdTdT | 1910 | 1518-1536 | CAAGUAAUUAUAGUGAGUUdTdT | 2477 |
| AD-62154.1 | ACUCACUAUAAUUACUUGAdTdT | 1911 | 1519-1537 | UCAAGUAAUUAUAGUGAGUdTdT | 2478 |
| AD-62113.1 | CUCACUAUAAUUACUUGAUdTdT | 1912 | 1520-1538 | AUCAAGUAAUUAUAGUGAGdTdT | 2479 |
| AD-62119.1 | UCACUAUAAUUACUUGAUUdTdT | 1913 | 1521-1539 | AAUCAAGUAAUUAUAGUGAdTdT | 2480 |
| AD-62125.1 | ACUAUAAUUACUUGAUUUUdTdT | 1914 | 1523-1541 | AAAAUCAAGUAAUUAUAGUdTdT | 2481 |
| AD-62131.1 | CUAUAAUUACUUGAUUUUAdTdT | 1915 | 1524-1542 | UAAAAUCAAGUAAUUAUAGdTdT | 2482 |
| AD-62137.1 | UAUAAUUACUUGAUUUUAUdTdT | 1916 | 1525-1543 | AUAAAAUCAAGUAAUUAUAdTdT | 2483 |
| AD-62143.1 | AUAAUUACUUGAUUUUAUCdTdT | 1917 | 1526-1544 | GAUAAAAUCAAGUAAUUAUdTdT | 2484 |
| AD-62149.1 | UAAUUACUUGAUUUUAUCCdTdT | 1918 | 1527-1545 | GGAUAAAAUCAAGUAAUUAdTdT | 2485 |
| AD-62155.1 | AAUUACUUGAUUUUAUCCAdTdT | 1919 | 1528-1546 | UGGAUAAAAUCAAGUAAUUdTdT | 2486 |
| AD-62114.1 | AUUACUUGAUUUUAUCCAAdTdT | 1920 | 1529-1547 | UUGGAUAAAAUCAAGUAAUdTdT | 2487 |
| AD-62120.1 | UUAUCCAAGGGCAAAAUUAdTdT | 1921 | 1540-1558 | UAAUUUUGCCCUUGGAUAAdTdT | 2488 |
| AD-62126.1 | GCAAAAUUAUCCACUUUGGdTdT | 1922 | 1550-1568 | CCAAAGUGGAUAAUUUUGCdTdT | 2489 |
| AD-62132.1 | CACUUUGGCACGAGGGAGAdTdT | 1923 | 1561-1579 | UCUCCCUCGUGCCAAAGUGdTdT | 2490 |
| AD-62138.1 | CGAGGGAGAAAUUUUCAGAdTdT | 1924 | 1571-1589 | UCUGAAAAUUUCUCCCUCGdTdT | 2491 |
| AD-62144.1 | AUUUUCAGAUGCAUCUUAUdTdT | 1925 | 1581-1599 | AUAAGAUGCAUCUGAAAAUdTdT | 2492 |
| AD-62150.1 | GCAUCUUAUCAAAGUAUAAdTdT | 1926 | 1591-1609 | UUAUACUUUGAUAAGAUGCdTdT | 2493 |
| AD-62156.1 | CAAAGUAUAAACAUUCCAGdTdT | 1927 | 1600-1618 | CUGGAAUGUUUAUACUUUGdTdT | 2494 |
| AD-62162.1 | AUUCCAGUAACACAGAACAdTdT | 1928 | 1612-1630 | UGUUCUGUGUUACUGGAAUdTdT | 2495 |
| AD-62168.1 | CACAGAACAUGGUUCCUUCdTdT | 1929 | 1622-1640 | GAAGGAACCAUGUUCUGUGdTdT | 2496 |
| AD-62174.1 | GGUUCCUUCAUCCCGACUUdTdT | 1930 | 1632-1650 | AAGUCGGGAUGAAGGAACCdTdT | 2497 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-62180.1 | CCCGACUUCUGGUCUAUUAdTdT | 1931 | 1643-1661 | UAAUAGACCAGAAGUCGGGdTdT | 2498 |
| AD-62186.1 | GGUCUAUUACAUCGUCACAdTdT | 1932 | 1653-1671 | UGUGACGAUGUAAUAGACCdTdT | 2499 |
| AD-62192.1 | AUCGUCACAGGAGAACAGAdTdT | 1933 | 1663-1681 | UCUGUUCUCCUGUGACGAUdTdT | 2500 |
| AD-62198.1 | CAGGAGAACAGACAGCAGAdTdT | 1934 | 1670-1688 | UCUGCUGUCUGUUCUCCUGdTdT | 2501 |
| AD-62157.1 | CAGCAGAAUUAGUGUCUGAdTdT | 1935 | 1682-1700 | UCAGACACUAAUUCUGCUGdTdT | 2502 |
| AD-62163.1 | GUGUCUGAUUCAGUCUGGUdTdT | 1936 | 1693-1711 | ACCAGACUGAAUCAGACACdTdT | 2503 |
| AD-62169.1 | CAGUCUGGUUAAAUAUUGAdTdT | 1937 | 1703-1721 | UCAAUAUUUAACCAGACUGdTdT | 2504 |
| AD-62175.1 | GUUAAAUAUUGAAGAAAAAdTdT | 1938 | 1710-1728 | UUUUUCUUCAAUAUUUAACdTdT | 2505 |
| AD-62181.1 | AGAAAAAUGUGGCAACCAGdTdT | 1939 | 1722-1740 | CUGGUUGCCACAUUUUUCUdTdT | 2506 |
| AD-62187.1 | GCAACCAGCUCCAGGUUCAdTdT | 1940 | 1733-1751 | UGAACCUGGAGCUGGUUGCdTdT | 2507 |
| AD-62193.1 | GCUCCAGGUUCAUCUGUCUdTdT | 1941 | 1740-1758 | AGACAGAUGAACCUGGAGCdTdT | 2508 |
| AD-62199.1 | AUCUGUCUCCUGAUGCAGAdTdT | 1942 | 1751-1769 | UCUGCAUCAGGAGACAGAUdTdT | 2509 |
| AD-62158.1 | GAUGCAGAUGCAUAUUCUCdTdT | 1943 | 1762-1780 | GAGAAUAUGCAUCUGCAUCdTdT | 2510 |
| AD-62164.1 | GCAUAUUCUCCAGGCCAAAdTdT | 1944 | 1771-1789 | UUUGGCCUGGAGAAUAUGCdTdT | 2511 |
| AD-62170.1 | AGGCCAAACUGUGUCUCUUdTdT | 1945 | 1782-1800 | AAGAGACACAGUUUGGCCUdTdT | 2512 |
| AD-62176.1 | GUGUCUCUUAAUAUGGCAAdTdT | 1946 | 1792-1810 | UUGCCAUAUUAAGAGACACdTdT | 2513 |
| AD-62182.1 | UUAAUAUGGCAACUGGAAUdTdT | 1947 | 1799-1817 | AUUCCAGUUGCCAUAUUAAdTdT | 2514 |
| AD-62188.1 | AACUGGAAUGGAUUCCUGGdTdT | 1948 | 1809-1827 | CCAGGAAUCCAUUCCAGUUdTdT | 2515 |
| AD-62194.1 | UUCCUGGGUGGCAUUAGCAdTdT | 1949 | 1821-1839 | UGCUAAUGCCACCCAGGAAdTdT | 2516 |
| AD-62200.1 | GGCAUUAGCAGCAGUGGACdTdT | 1950 | 1830-1848 | GUCCACUGCUGCUAAUGCCdTdT | 2517 |
| AD-62159.1 | AGUGGACAGUGCUGUGUAUdTdT | 1951 | 1842-1860 | AUACACAGCACUGUCCACUdTdT | 2518 |
| AD-62165.1 | GCUGUGUAUGGAGUCCAAAdTdT | 1952 | 1852-1870 | UUUGGACUCCAUACACAGCdTdT | 2519 |
| AD-62171.1 | AGUCCAAAGAGGAGCCAAAdTdT | 1953 | 1863-1881 | UUUGGCUCCUCUUUGGACUdTdT | 2520 |
| AD-62177.1 | AGAGGAGCCAAAAAGCCCUdTdT | 1954 | 1870-1888 | AGGGCUUUUUGGCUCCUCUdTdT | 2521 |
| AD-62183.1 | AGCCCUUGGAAAGAGUAUUdTdT | 1955 | 1883-1901 | AAUACUCUUUCCAAGGGCUdTdT | 2522 |
| AD-62189.1 | AAGAGUAUUUCAAUUCUUAdTdT | 1956 | 1893-1911 | UAAGAAUUGAAAUACUCUUdTdT | 2523 |
| AD-62195.1 | UUUCAAUUCUUAGAGAAGAdTdT | 1957 | 1900-1918 | UCUUCUCUAAGAAUUGAAAdTdT | 2524 |
| AD-62201.1 | GAGAAGAGUGAUCUGGGCUdTdT | 1958 | 1912-1930 | AGCCCAGAUCACUCUUCUCdTdT | 2525 |
| AD-62160.1 | UGAUCUGGGCUGUGGGGCAdTdT | 1959 | 1920-1938 | UGCCCCACAGCCCAGAUCAdTdT | 2526 |
| AD-62166.1 | GGGGCAGGUGGUGGCCUCAdTdT | 1960 | 1933-1951 | UGAGGCCACCACCUGCCCCdTdT | 2527 |
| AD-62172.1 | GUGGCCUCAACAAUGCCAAdTdT | 1961 | 1943-1961 | UUGGCAUUGUUGAGGCCACdTdT | 2528 |
| AD-62178.1 | CAACAAUGCCAAUGUGUUCdTdT | 1962 | 1950-1968 | GAACACAUUGGCAUUGUUGdTdT | 2529 |
| AD-62184.1 | CAAUGUGUUCCACCUAGCUdTdT | 1963 | 1959-1977 | AGCUAGGUGGAACACAUUGdTdT | 2530 |
| AD-62190.1 | CACCUAGCUGGACUUACCUdTdT | 1964 | 1969-1987 | AGGUAAGUCCAGCUAGGUGdTdT | 2531 |
| AD-62196.1 | GACUUACCUUCCUCACUAAdTdT | 1965 | 1979-1997 | UUAGUGAGGAAGGUAAGUCdTdT | 2532 |
| AD-62202.1 | UCACUAAUGCAAAUGCAGAdTdT | 1966 | 1991-2009 | UCUGCAUUUGCAUUAGUGAdTdT | 2533 |
| AD-62161.1 | AAAUGCAGAUGACUCCCAAdTdT | 1967 | 2001-2019 | UUGGGAGUCAUCUGCAUUUdTdT | 2534 |
| AD-62167.1 | CUCCCAAGAAAAUGAUGAAdTdT | 1968 | 2013-2031 | UUCAUCAUUUUCUUGGGAGdTdT | 2535 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-62173.1 | CCUUGUAAAGAAAUUCUCAdTdT | 1969 | 2032-2050 | UGAGAAUUUCUUUACAAGGdTdT | 2536 |
| AD-62179.1 | AAUUCUCAGGCCAAGAAGAdTdT | 1970 | 2043-2061 | UCUUCUUGGCCUGAGAAUUdTdT | 2537 |
| AD-62185.1 | CCAAGAAGAACGCUGCAAAdTdT | 1971 | 2053-2071 | UUUGCAGCGUUCUUCUUGGdTdT | 2538 |
| AD-62191.1 | CGCUGCAAAAGAAGAUAGAdTdT | 1972 | 2063-2081 | UCUAUCUUCUUUUGCAGCGdTdT | 2539 |
| AD-62197.1 | AAAGAAGAUAGAAGAAAUAdTdT | 1973 | 2070-2088 | UAUUUCUUCUAUCUUCUUUdTdT | 2540 |
| AD-62203.1 | AGAAAUAGCUGCUAAAUAUdTdT | 1974 | 2082-2100 | AUAUUUAGCAGCUAUUUCUdTdT | 2541 |
| AD-62209.1 | GCUGCUAAAUAUAAACAUUdTdT | 1975 | 2089-2107 | AAUGUUUAUAUUUAGCAGCdTdT | 2542 |
| AD-62215.1 | ACAUUCAGUAGUGAAGAAAdTdT | 1976 | 2103-2121 | UUUCUUCACUACUGAAUGUdTdT | 2543 |
| AD-62221.1 | GUAGUGAAGAAAUGUUGUUdTdT | 1977 | 2110-2128 | AACAACAUUUCUUCACUACdTdT | 2544 |
| AD-62227.1 | AAAUGUUGUUACGAUGGAGdTdT | 1978 | 2119-2137 | CUCCAUCGUAACAACAUUUdTdT | 2545 |
| AD-62233.1 | CGAUGGAGCCUGCGUUAAUdTdT | 1979 | 2130-2148 | AUUAACGCAGGCUCCAUCGdTdT | 2546 |
| AD-62239.1 | CGUUAAUAAUGAUGAAACCdTdT | 1980 | 2142-2160 | GGUUUCAUCAUUAUUAACGdTdT | 2547 |
| AD-62245.1 | AUGAUGAAACCUGUGAGCAdTdT | 1981 | 2150-2168 | UGCUCACAGGUUUCAUCAUdTdT | 2548 |
| AD-62204.1 | CUGUGAGCAGCGAGCUGCAdTdT | 1982 | 2160-2178 | UGCAGCUCGCUGCUCACAGdTdT | 2549 |
| AD-62210.1 | CGAGCUGCACGGAUUAGUUdTdT | 1983 | 2170-2188 | AACUAAUCCGUGCAGCUCGdTdT | 2550 |
| AD-62216.1 | GGAUUAGUUUAGGGCCAAGdTdT | 1984 | 2180-2198 | CUUGGCCCUAAACUAAUCCdTdT | 2551 |
| AD-62222.1 | GGGCCAAGAUGCAUCAAAGdTdT | 1985 | 2191-2209 | CUUUGAUGCAUCUUGGCCCdTdT | 2552 |
| AD-62228.1 | CAUCAAAGCUUUCACUGAAdTdT | 1986 | 2202-2220 | UUCAGUGAAAGCUUUGAUGdTdT | 2553 |
| AD-62234.1 | GCUUUCACUGAAUGUUGUGdTdT | 1987 | 2209-2227 | CACAACAUUCAGUGAAAGCdTdT | 2554 |
| AD-62240.1 | AAUGUUGUGUCGUCGCAAGdTdT | 1988 | 2219-2237 | CUUGCGACGACACAACAUUdTdT | 2555 |
| AD-62246.1 | CGUCGCAAGCCAGCUCCGUdTdT | 1989 | 2229-2247 | ACGGAGCUGGCUUGCGACGdTdT | 2556 |
| AD-62205.1 | GCUCCGUGCUAAUAUCUCUdTdT | 1990 | 2241-2259 | AGAGAUAUUAGCACGGAGCdTdT | 2557 |
| AD-62211.1 | CUAAUAUCUCUCAUAAAGAdTdT | 1991 | 2249-2267 | UCUUUAUGAGAGAUAUUAGdTdT | 2558 |
| AD-62217.1 | AAAGACAUGCAAUUGGGAAdTdT | 1992 | 2263-2281 | UUCCCAAUUGCAUGUCUUUdTdT | 2559 |
| AD-62223.1 | CAAUUGGGAAGGCUACACAdTdT | 1993 | 2272-2290 | UGUGUAGCCUUCCCAAUUGdTdT | 2560 |
| AD-62229.1 | GCUACACAUGAAGACCCUGdTdT | 1994 | 2283-2301 | CAGGGUCUUCAUGUGUAGCdTdT | 2561 |
| AD-62235.1 | CAUGAAGACCCUGUUACCAdTdT | 1995 | 2289-2307 | UGGUAACAGGGUCUUCAUGdTdT | 2562 |
| AD-62241.1 | UACCAGUAAGCAAGCCAGAdTdT | 1996 | 2303-2321 | UCUGGCUUGCUUACUGGUAdTdT | 2563 |
| AD-62247.1 | AGCAAGCCAGAAAUUCGGAdTdT | 1997 | 2311-2329 | UCCGAAUUUCUGGCUUGCUdTdT | 2564 |
| AD-62206.1 | AGAAAUUCGGAGUUAUUUUdTdT | 1998 | 2319-2337 | AAAAUAACUCCGAAUUUCUdTdT | 2565 |
| AD-62212.1 | AGUUAUUUUCCAGAAAGCUdTdT | 1999 | 2329-2347 | AGCUUUCUGGAAAAUAACUdTdT | 2566 |
| AD-62218.1 | CAGAAAGCUGGUUGGGGAdTdT | 2000 | 2339-2357 | UCCCACAACCAGCUUUCUGdTdT | 2567 |
| AD-62224.1 | GUGGGAAGUUCAUCUUGUUdTdT | 2001 | 2352-2370 | AACAAGAUGAACUUCCCACdTdT | 2568 |
| AD-62230.1 | UCAUCUUGUUCCCAGAAGAdTdT | 2002 | 2361-2379 | UCUUCUGGGAACAAGAUGAdTdT | 2569 |
| AD-62236.1 | CCAGAAGAAAACAGUUGCAdTdT | 2003 | 2372-2390 | UGCAACUGUUUUCUUCUGGdTdT | 2570 |
| AD-62242.1 | CAGUUGCAGUUUGCCCUAdTdT | 2004 | 2383-2401 | GUAGGGCAAACUGCAACUGdTdT | 2571 |
| AD-62248.1 | CAGUUUGCCCUACCUGAUUdTdT | 2005 | 2389-2407 | AAUCAGGUAGGGCAAACUGdTdT | 2572 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-62207.1 | CCUGAUUCUCUAACCACCUdTdT | 2006 | 2401-2419 | AGGUGGUUAGAGAAUCAGGdTdT | 2573 |
| AD-62213.1 | ACCACCUGGGAAAUUCAAGdTdT | 2007 | 2413-2431 | CUUGAAUUUCCCAGGUGGUdTdT | 2574 |
| AD-62219.1 | GAAAUUCAAGGCGUUGGCAdTdT | 2008 | 2422-2440 | UGCCAACGCCUUGAAUUUCdTdT | 2575 |
| AD-62225.1 | CGUUGGCAUUUCAAACACUdTdT | 2009 | 2433-2451 | AGUGUUUGAAAUGCCAACGdTdT | 2576 |
| AD-62231.1 | CAUUUCAAACACUGGUAUAdTdT | 2010 | 2439-2457 | UAUACCAGUGUUUGAAAUGdTdT | 2577 |
| AD-62237.1 | GUAUAUGUGUUGCUGAUACdTdT | 2011 | 2453-2471 | GUAUCAGCAACACAUAUACdTdT | 2578 |
| AD-62243.1 | UGCUGAUACUGUCAAGGCAdTdT | 2012 | 2463-2481 | UGCCUUGACAGUAUCAGCAdTdT | 2579 |
| AD-62249.1 | CUGUCAAGGCAAAGGUGUUdTdT | 2013 | 2471-2489 | AACACCUUUGCCUUGACAGdTdT | 2580 |
| AD-62208.1 | AGGUGUUCAAAGAUGUCUUdTdT | 2014 | 2483-2501 | AAGACAUCUUUGAACACCUdTdT | 2581 |
| AD-62214.1 | CAAAGAUGUCUUCCUGGAAdTdT | 2015 | 2490-2508 | UUCCAGGAAGACAUCUUUGdTdT | 2582 |
| AD-62220.1 | CUUCCUGGAAAUGAAUAUAdTdT | 2016 | 2499-2517 | UAUAUUCAUUUCCAGGAAGdTdT | 2583 |
| AD-62226.1 | GAAUAUACCAUAUUCUGUUdTdT | 2017 | 2511-2529 | AACAGAAUAUGGUAUAUUCdTdT | 2584 |
| AD-62232.1 | AUAUUCUGUUGUACGAGGAdTdT | 2018 | 2520-2538 | UCCUCGUACAACAGAAUAUdTdT | 2585 |
| AD-62238.1 | CGAGGAGAACAGAUCCAAUdTdT | 2019 | 2533-2551 | AUUGGAUCUGUUCUCCUCGdTdT | 2586 |
| AD-62244.1 | GAACAGAUCCAAUUGAAAGdTdT | 2020 | 2539-2557 | CUUUCAAUUGGAUCUGUUCdTdT | 2587 |
| AD-61874.1 | GAAAGGAACUGUUUACAACdTdT | 2021 | 2553-2571 | GUUGUAAACAGUUCCUUUCdTdT | 2588 |
| AD-61880.1 | ACUGUUUACAACUAUAGGAdTdT | 2022 | 2560-2578 | UCCUAUAGUUGUAAACAGUdTdT | 2589 |
| AD-61886.1 | AACUAUAGGACUUCUGGAdTdT | 2023 | 2569-2587 | UCCCAGAAGUCCUAUAGUUdTdT | 2590 |
| AD-61892.1 | UGGGAUGCAGUUCUGUGUUdTdT | 2024 | 2583-2601 | AACACAGAACUGCAUCCCAdTdT | 2591 |
| AD-61898.1 | GUUCUGUGUUAAAAUGUCUdTdT | 2025 | 2592-2610 | AGACAUUUUAACACAGAACdTdT | 2592 |
| AD-61904.1 | UUAAAAUGUCUGCUGUGGAdTdT | 2026 | 2600-2618 | UCCACAGCAGACAUUUUAAdTdT | 2593 |
| AD-61910.1 | CUGUGGAGGGAAUCUGCACdTdT | 2027 | 2612-2630 | GUGCAGAUUCCCUCCACAGdTdT | 2594 |
| AD-61916.1 | GGAAUCUGCACUUCGGAAAdTdT | 2028 | 2620-2638 | UUUCCGAAGUGCAGAUUCCdTdT | 2595 |
| AD-61875.1 | CGGAAAGCCCAGUCAUUGAdTdT | 2029 | 2633-2651 | UCAAUGACUGGGCUUUCCGdTdT | 2596 |
| AD-61881.1 | CCAGUCAUUGAUCAUCAGGdTdT | 2030 | 2641-2659 | CCUGAUGAUCAAUGACUGGdTdT | 2597 |
| AD-61887.1 | CAUCAGGGCACAAAGUCCUdTdT | 2031 | 2653-2671 | AGGACUUUGUGCCCUGAUGdTdT | 2598 |
| AD-61893.1 | GGCACAAAGUCCUCCAAAUdTdT | 2032 | 2659-2677 | AUUUGGAGGACUUUGUGCCdTdT | 2599 |
| AD-61899.1 | CAAAUGUGUGCGCCAGAAAdTdT | 2033 | 2673-2691 | UUUCUGGCGCACACAUUUGdTdT | 2600 |
| AD-61905.1 | GCGCCAGAAAGUAGAGGGCdTdT | 2034 | 2682-2700 | GCCCUCUACUUUCUGGCGCdTdT | 2601 |
| AD-61911.1 | AGUAGAGGGCUCCUCCAGUdTdT | 2035 | 2691-2709 | ACUGGAGGAGCCCUCUACUdTdT | 2602 |
| AD-61917.1 | CCUCCAGUCACUUGGUGACdTdT | 2036 | 2702-2720 | GUCACCAAGUGACUGGAGGdTdT | 2603 |
| AD-61876.1 | UCACUUGGUGACAUUCACUdTdT | 2037 | 2709-2727 | AGUGAAUGUCACCAAGUGAdTdT | 2604 |
| AD-61882.1 | CAUUCACUGUGCUUCCUCUdTdT | 2038 | 2720-2738 | AGAGGAAGCACAGUGAAUGdTdT | 2605 |
| AD-61888.1 | GGAAUUGGCCUUCACAACdTdT | 2039 | 2739-2757 | GUUGUGAAGGCCAAUUUCCdTdT | 2606 |
| AD-61894.1 | CUUCACAACAUCAAUUUUUdTdT | 2040 | 2749-2767 | AAAAAUUGAUGUUGUGAAGdTdT | 2607 |
| AD-61900.1 | AAUUUUUCACUGGAGACUUdTdT | 2041 | 2761-2779 | AAGUCUCCAGUGAAAAAUUdTdT | 2608 |
| AD-61906.1 | CUGGAGACUUGGUUUGGAAdTdT | 2042 | 2770-2788 | UUCCAAACCAAGUCUCCAGdTdT | 2609 |
| AD-61912.1 | GGUUUGGAAAAGAAAUCUUdTdT | 2043 | 2780-2798 | AAGAUUUCUUUUCCAAACCdTdT | 2610 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-61918.1 | AAUCUUAGUAAAAACAUUAdTdT | 2044 | 2793-2811 | UAAUGUUUUUACUAAGAUUdTdT | 2611 |
| AD-61877.1 | AAAAACAUUACGAGUGGUGdTdT | 2045 | 2802-2820 | CACCACUCGUAAUGUUUUUdTdT | 2612 |
| AD-61883.1 | GAGUGGUGCCAGAAGGUGUdTdT | 2046 | 2813-2831 | ACACCUUCUGGCACCACUCdTdT | 2613 |
| AD-61889.1 | AGAAGGUGUCAAAAGGGAAdTdT | 2047 | 2823-2841 | UUCCCUUUUGACACCUUCUdTdT | 2614 |
| AD-61895.1 | UGUCAAAAGGGAAAGCUAUdTdT | 2048 | 2829-2847 | AUAGCUUUCCCUUUUGACAdTdT | 2615 |
| AD-61901.1 | GCUAUUCUGGUGUUACUUUdTdT | 2049 | 2843-2861 | AAAGUAACACCAGAAUAGCdTdT | 2616 |
| AD-61907.1 | GUGUUACUUUGGAUCCUAGdTdT | 2050 | 2852-2870 | CUAGGAUCCAAAGUAACACdTdT | 2617 |
| AD-61913.1 | GGAUCCUAGGGGUAUUUAUdTdT | 2051 | 2862-2880 | AUAAAUACCCCUAGGAUCCdTdT | 2618 |
| AD-61919.1 | GGUAUUUAUGGUACCAUUAdTdT | 2052 | 2872-2890 | UAAUGGUACCAUAAAUACCdTdT | 2619 |
| AD-61878.1 | GUACCAUUAGCAGACGAAAdTdT | 2053 | 2882-2900 | UUUCGUCUGCUAAUGGUACdTdT | 2620 |
| AD-61884.1 | CAGACGAAAGGAGUUCCCAdTdT | 2054 | 2892-2910 | UGGGAACUCCUUUCGUCUGdTdT | 2621 |
| AD-61890.1 | AGGAGUUCCCAUACAGGAUdTdT | 2055 | 2900-2918 | AUCCUGUAUGGGAACUCCUdTdT | 2622 |
| AD-61896.1 | CAUACAGGAUACCCUUAGAdTdT | 2056 | 2909-2927 | UCUAAGGGUAUCCUGUAUGdTdT | 2623 |
| AD-61902.1 | CUUAGAUUUGGUCCCCAAAdTdT | 2057 | 2922-2940 | UUUGGGGACCAAAUCUAAGdTdT | 2624 |
| AD-61908.1 | UCCCCAAAACAGAAAUCAAdTdT | 2058 | 2933-2951 | UUGAUUUCUGUUUUGGGGAdTdT | 2625 |
| AD-61914.1 | ACAGAAAUCAAAAGGAUUUdTdT | 2059 | 2941-2959 | AAAUCCUUUUGAUUUCUGUdTdT | 2626 |
| AD-61920.1 | AAAGGAUUUUGAGUGUAAAdTdT | 2060 | 2951-2969 | UUUACACUCAAAAUCCUUUdTdT | 2627 |
| AD-61879.1 | AGUGUAAAAGGACUGCUUGdTdT | 2061 | 2962-2980 | CAAGCAGUCCUUUUACACUdTdT | 2628 |
| AD-61885.1 | AAGGACUGCUUGUAGGUGAdTdT | 2062 | 2969-2987 | UCACCUACAAGCAGUCCUUdTdT | 2629 |
| AD-61891.1 | GUAGGUGAGAUCUUGUCUGdTdT | 2063 | 2980-2998 | CAGACAAGAUCUCACCUACdTdT | 2630 |
| AD-61897.1 | AUCUUGUCUGCAGUUCUAAdTdT | 2064 | 2989-3007 | UUAGAACUGCAGACAAGAUdTdT | 2631 |
| AD-61903.1 | GUUCUAAGUCAGGAAGGCAdTdT | 2065 | 3001-3019 | UGCCUUCCUGACUUAGAACdTdT | 2632 |
| AD-61909.1 | GAAGGCAUCAAUAUCCUAAdTdT | 2066 | 3013-3031 | UUAGGAUAUUGAUGCCUUCdTdT | 2633 |
| AD-61915.1 | UCAAUAUCCUAACCCACCUdTdT | 2067 | 3020-3038 | AGGUGGGUUAGGAUAUUGAdTdT | 2634 |
| AD-61921.1 | CCACCUCCCCAAAGGGAGUdTdT | 2068 | 3033-3051 | ACUCCCUUUGGGGAGGUGGdTdT | 2635 |
| AD-61927.1 | CCCCAAAGGGAGUGCAGAGdTdT | 2069 | 3039-3057 | CUCUGCACUCCCUUUGGGGdTdT | 2636 |
| AD-61933.1 | GUGCAGAGGCGGAGCUGAUdTdT | 2070 | 3050-3068 | AUCAGCUCCGCCUCUGCACdTdT | 2637 |
| AD-61939.1 | GGAGCUGAUGAGCGUUGUCdTdT | 2071 | 3060-3078 | GACAACGCUCAUCAGCUCCdTdT | 2638 |
| AD-61945.1 | CGUUGUCCCAGUAUUCUAUdTdT | 2072 | 3072-3090 | AUAGAAUACUGGGACAACGdTdT | 2639 |
| AD-61951.1 | CCAGUAUUCUAUGUUUUUCdTdT | 2073 | 3079-3097 | GAAAAACAUAGAAUACUGGdTdT | 2640 |
| AD-61957.1 | GUUUUUCACUACCUGGAAAdTdT | 2074 | 3091-3109 | UUUCCAGGUAGUGAAAAACdTdT | 2641 |
| AD-61963.1 | CCUGGAAACAGGAAAUCAUdTdT | 2075 | 3102-3120 | AUGAUUUCCUGUUUCCAGGdTdT | 2642 |
| AD-61922.1 | GGAACAUUUUCAUUCUGAdTdT | 2076 | 3122-3140 | UCAGAAUGAAAAAUGUUCCdTdT | 2643 |
| AD-61928.1 | CAUUCUGACCCAUUAAUUGdTdT | 2077 | 3133-3151 | CAAUUAAUGGGUCAGAAUGdTdT | 2644 |
| AD-61934.1 | CCAUUAAUUGAAAAGCAGAdTdT | 2078 | 3142-3160 | UCUGCUUUUCAAUUAAUGGdTdT | 2645 |
| AD-61940.1 | AAAGCAGAAACUGAAGAAAdTdT | 2079 | 3153-3171 | UUUCUUCAGUUUCUGCUUUdTdT | 2646 |
| AD-61946.1 | AACUGAAGAAAAAAUUAAAdTdT | 2080 | 3161-3179 | UUUAAUUUUUUCUUCAGUUdTdT | 2647 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-61952.1 | AAAAAAUUAAAAGAAGGGAdTdT | 2081 | 3169-3187 | UCCCUUCUUUUAAUUUUUUdTdT | 2648 |
| AD-61958.1 | AGGGAUGUUGAGCAUUAUGdTdT | 2082 | 3183-3201 | CAUAAUGCUCAACAUCCCUdTdT | 2649 |
| AD-61964.1 | GAGCAUUAUGUCCUACAGAdTdT | 2083 | 3192-3210 | UCUGUAGGACAUAAUGCUCdTdT | 2650 |
| AD-61923.1 | UGUCCUACAGAAAUGCUGAdTdT | 2084 | 3200-3218 | UCAGCAUUUCUGUAGGACAdTdT | 2651 |
| AD-61929.1 | AAUGCUGACUACUCUUACAdTdT | 2085 | 3211-3229 | UGUAAGAGUAGUCAGCAUUdTdT | 2652 |
| AD-61935.1 | UACUCUUACAGUGUGUGGAdTdT | 2086 | 3220-3238 | UCCACACACUGUAAGAGUAdTdT | 2653 |
| AD-61941.1 | AGUGUGUGGAAGGGUGGAAdTdT | 2087 | 3229-3247 | UUCCACCCUUCCACACACUdTdT | 2654 |
| AD-61947.1 | GGGUGGAAGUGCUAGCACUdTdT | 2088 | 3240-3258 | AGUGCUAGCACUUCCACCCdTdT | 2655 |
| AD-61953.1 | GCUAGCACUUGGUUAACAGdTdT | 2089 | 3250-3268 | CUGUUAACCAAGUGCUAGCdTdT | 2656 |
| AD-61959.1 | GGUUAACAGCUUUUGCUUUdTdT | 2090 | 3260-3278 | AAAGCAAAAGCUGUUAACCdTdT | 2657 |
| AD-61965.1 | UGCUUUAAGAGUACUUGGAdTdT | 2091 | 3273-3291 | UCCAAGUACUCUUAAAGCAdTdT | 2658 |
| AD-61924.1 | GUACUUGGACAAGUAAAUAdTdT | 2092 | 3283-3301 | UAUUUACUUGUCCAAGUACdTdT | 2659 |
| AD-61930.1 | CAAGUAAAUAAAUACGUAGdTdT | 2093 | 3292-3310 | CUACGUAUUUAUUUACUUGdTdT | 2660 |
| AD-61936.1 | AUAAAUACGUAGAGCAGAAdTdT | 2094 | 3299-3317 | UUCUGCUCUACGUAUUUAUdTdT | 2661 |
| AD-61942.1 | GAGCAGAACCAAAAUUCAAdTdT | 2095 | 3310-3328 | UUGAAUUUUGGUUCUGCUCdTdT | 2662 |
| AD-61948.1 | AAUUCAAUUUGUAAUUCUUdTdT | 2096 | 3322-3340 | AAGAAUUACAAAUUGAAUUdTdT | 2663 |
| AD-61954.1 | GUAAUUCUUUAUUGUGGCUdTdT | 2097 | 3332-3350 | AGCCACAAUAAAGAAUUACdTdT | 2664 |
| AD-61960.1 | AUUGUGGCUAGUUGAGAAUdTdT | 2098 | 3342-3360 | AUUCUCAACUAGCCACAAUdTdT | 2665 |
| AD-61966.1 | CUAGUUGAGAAUUAUCAAUdTdT | 2099 | 3349-3367 | AUUGAUAAUUCUCAACUAGdTdT | 2666 |
| AD-61925.1 | UUAUCAAUUAGAUAAUGGAdTdT | 2100 | 3360-3378 | UCCAUUAUCUAAUUGAUAAdTdT | 2667 |
| AD-61931.1 | AAUGGAUCUUUCAAGGAAAdTdT | 2101 | 3373-3391 | UUUCCUUGAAAGAUCCAUUdTdT | 2668 |
| AD-61937.1 | CUUUCAAGGAAAAUUCACAdTdT | 2102 | 3380-3398 | UGUGAAUUUUCCUUGAAAGdTdT | 2669 |
| AD-61943.1 | AAUUCACAGUAUCAACCAAdTdT | 2103 | 3391-3409 | UUGGUUGAUACUGUGAAUUdTdT | 2670 |
| AD-61949.1 | GUAUCAACCAAUAAAAUUAdTdT | 2104 | 3399-3417 | UAAUUUUAUUGGUUGAUACdTdT | 2671 |
| AD-61955.1 | AAAAUUACAGGGUACCUUGdTdT | 2105 | 3411-3429 | CAAGGUACCCUGUAAUUUUdTdT | 2672 |
| AD-61961.1 | AGGGUACCUUGCCUGUUGAdTdT | 2106 | 3419-3437 | UCAACAGGCAAGGUACCCUdTdT | 2673 |
| AD-61967.1 | GUUGAAGCCCGAGAGAACAdTdT | 2107 | 3433-3451 | UGUUCUCUCGGGCUUCAACdTdT | 2674 |
| AD-61926.1 | CCGAGAGAACAGCUUAUAUdTdT | 2108 | 3441-3459 | AUAUAAGCUGUUCUCUCGGdTdT | 2675 |
| AD-61932.1 | GCUUAUAUCUUACAGCCUUdTdT | 2109 | 3452-3470 | AAGGCUGUAAGAUAUAAGCdTdT | 2676 |
| AD-61938.1 | CUUACAGCCUUUACUGUGAdTdT | 2110 | 3460-3478 | UCACAGUAAAGGCUGUAAGdTdT | 2677 |
| AD-61944.1 | GAAUUAGAAAGGCUUUCGAdTdT | 2111 | 3482-3500 | UCGAAAGCCUUUCUAAUUCdTdT | 2678 |
| AD-61950.1 | GGCUUUCGAUAUAUGCCCCdTdT | 2112 | 3492-3510 | GGGGCAUAUAUCGAAAGCCdTdT | 2679 |
| AD-61956.1 | GAUAUAUGCCCCUGGUGAdTdT | 2113 | 3499-3517 | UCACCAGGGGGCAUAUAUCdTdT | 2680 |
| AD-61962.1 | GGUGAAAAUCGACACAGCUdTdT | 2114 | 3513-3531 | AGCUGUGUCGAUUUUCACCdTdT | 2681 |
| AD-61968.1 | CGACACAGCUCUAAUUAAAdTdT | 2115 | 3522-3540 | UUUAAUUAGAGCUGUGUCGdTdT | 2682 |
| AD-61974.1 | GCUCUAAUUAAAGCUGACAdTdT | 2116 | 3529-3547 | UGUCAGCUUUAAUUAGAGCdTdT | 2683 |
| AD-61980.1 | CUGACAACUUUCUGCUUGAdTdT | 2117 | 3542-3560 | UCAAGCAGAAAGUUGUCAGdTdT | 2684 |
| AD-61986.1 | CUUUCUGCUUGAAAAUACAdTdT | 2118 | 3549-3567 | UGUAUUUUCAAGCAGAAAGdTdT | 2685 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-61992.1 | AAAAUACACUGCCAGCCCAdTdT | 2119 | 3560-3578 | UGGGCUGGCAGUGUAUUUUdTdT | 2686 |
| AD-61998.1 | AGCCCAGAGCACCUUUACAdTdT | 2120 | 3573-3591 | UGUAAAGGUGCUCUGGGCUdTdT | 2687 |
| AD-62004.1 | GCACCUUUACAUUGGCCAUdTdT | 2121 | 3581-3599 | AUGGCCAAUGUAAAGGUGCdTdT | 2688 |
| AD-62010.1 | ACAUUGGCCAUUUCUGCGUdTdT | 2122 | 3589-3607 | ACGCAGAAAUGGCCAAUGUdTdT | 2689 |
| AD-61969.1 | CUGCGUAUGCUCUUUCCCUdTdT | 2123 | 3602-3620 | AGGGAAAGAGCAUACGCAGdTdT | 2690 |
| AD-61975.1 | CUUUCCCUGGGAGAUAAAAdTdT | 2124 | 3613-3631 | UUUUAUCUCCCAGGGAAAGdTdT | 2691 |
| AD-61981.1 | GAGAUAAAACUCACCCACAdTdT | 2125 | 3623-3641 | UGUGGGUGAGUUUUAUCUCdTdT | 2692 |
| AD-61987.1 | ACUCACCCACAGUUUCGUUdTdT | 2126 | 3631-3649 | AACGAAACUGUGGGUGAGUdTdT | 2693 |
| AD-61993.1 | CAGUUUCGUUCAUUGUUUdTdT | 2127 | 3640-3658 | AAACAAUUGAACGAAACUGdTdT | 2694 |
| AD-61999.1 | CAAUUGUUUCAGCUUUGAAdTdT | 2128 | 3650-3668 | UUCAAAGCUGAAACAAUUGdTdT | 2695 |
| AD-62005.1 | CUUUGAAGAGAGAAGCUUUdTdT | 2129 | 3662-3680 | AAAGCUUCUCUCUUCAAAGdTdT | 2696 |
| AD-62011.1 | GAGAGAAGCUUUGGUUAAAdTdT | 2130 | 3669-3687 | UUUAACCAAAGCUUCUCUCdTdT | 2697 |
| AD-61970.1 | GUUAAAGGUAAUCCACCCAdTdT | 2131 | 3682-3700 | UGGGUGGAUUACCUUUAACdTdT | 2698 |
| AD-61976.1 | AAUCCACCCAUUUAUCGUUdTdT | 2132 | 3691-3709 | AACGAUAAAUGGGUGGAUUdTdT | 2699 |
| AD-61982.1 | CAUUUAUCGUUUUUGGAAAdTdT | 2133 | 3699-3717 | UUUCCAAAAACGAUAAAUGdTdT | 2700 |
| AD-61988.1 | UUUGGAAAGACAAUCUUCAdTdT | 2134 | 3710-3728 | UGAAGAUUGUCUUUCCAAAdTdT | 2701 |
| AD-61994.1 | AAUCUUCAGCAUAAAGACAdTdT | 2135 | 3721-3739 | UGUCUUUAUGCUGAAGAUUdTdT | 2702 |
| AD-62006.1 | CUCUGUACCUAACACUGGUdTdT | 2136 | 3741-3759 | ACCAGUGUUAGGUACAGAGdTdT | 2703 |
| AD-62012.1 | ACACUGGUACGGCACGUAUdTdT | 2137 | 3752-3770 | AUACGUGCCGUACCAGUGUdTdT | 2704 |
| AD-61971.1 | GGCACGUAUGGUAGAAACAdTdT | 2138 | 3762-3780 | UGUUUCUACCAUACGUGCCdTdT | 2705 |
| AD-61977.1 | GGUAGAAACAACUGCCUAUdTdT | 2139 | 3771-3789 | AUAGGCAGUUGUUUCUACCdTdT | 2706 |
| AD-61983.1 | CAACUGCCUAUGCUUUACUdTdT | 2140 | 3779-3797 | AGUAAAGCAUAGGCAGUUGdTdT | 2707 |
| AD-61989.1 | CUUUACUCACCAGUCUGAAdTdT | 2141 | 3791-3809 | UUCAGACUGGUGAGUAAAGdTdT | 2708 |
| AD-61995.1 | GUCUGAACUUGAAAGAUAUdTdT | 2142 | 3803-3821 | AUAUCUUUCAAGUUCAGACdTdT | 2709 |
| AD-62001.1 | ACUUGAAAGAUAUAAAUUAdTdT | 2143 | 3809-3827 | UAAUUUAUAUCUUUCAAGUdTdT | 2710 |
| AD-62007.1 | UAUAAAUUAUGUUAACCCAdTdT | 2144 | 3819-3837 | UGGGUUAACAUAAUUUAUAdTdT | 2711 |
| AD-62013.1 | GUUAACCCAGUCAUCAAAUdTdT | 2145 | 3829-3847 | AUUUGAUGACUGGGUUAACdTdT | 2712 |
| AD-61972.1 | UCAUCAAAUGGCUAUCAGAdTdT | 2146 | 3839-3857 | UCUGAUAGCCAUUUGAUGAdTdT | 2713 |
| AD-61978.1 | UAUCAGAAGAGCAGAGGUAdTdT | 2147 | 3851-3869 | UACCUCUGCUCUUCUGAUAdTdT | 2714 |
| AD-61984.1 | AGAGGUAUGGAGGUGGCUUdTdT | 2148 | 3863-3881 | AAGCCACCUCCAUACCUCUdTdT | 2715 |
| AD-61990.1 | GAGGUGGCUUUUAUUCAACdTdT | 2149 | 3872-3890 | GUUGAAUAAAAGCCACCUCdTdT | 2716 |
| AD-61996.1 | UAUUCAACCCAGGACACAAdTdT | 2150 | 3883-3901 | UUGUGUCCUGGGUUGAAUAdTdT | 2717 |
| AD-62002.1 | AGGACACAAUCAAUGCCAUdTdT | 2151 | 3893-3911 | AUGGCAUUGAUUGUGUCCUdTdT | 2718 |
| AD-62008.1 | CAAUCAAUGCCAUUGAGGGdTdT | 2152 | 3899-3917 | CCCUCAAUGGCAUUGAUUGdTdT | 2719 |
| AD-62014.1 | CAUUGAGGGCCUGACGGAAdTdT | 2153 | 3909-3927 | UUCCGUCAGGCCCUCAAUGdTdT | 2720 |
| AD-61973.1 | ACGGAAUAUUCACUCCUGGdTdT | 2154 | 3922-3940 | CCAGGAGUGAAUAUUCCGUdTdT | 2721 |
| AD-61979.1 | UUCACUCCUGGUUAAACAAdTdT | 2155 | 3930-3948 | UUGUUUAACCAGGAGUGAAdTdT | 2722 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-61985.1 | GGUUAAACAACUCCGCUUGdTdT | 2156 | 3939-3957 | CAAGCGGAGUUGUUUAACCdTdT | 2723 |
| AD-61991.1 | CCGCUUGAGUAUGGACAUCdTdT | 2157 | 3951-3969 | GAUGUCCAUACUCAAGCGGdTdT | 2724 |
| AD-61997.1 | GGACAUCGAUGUUUCUUACdTdT | 2158 | 3963-3981 | GUAAGAAACAUCGAUGUCCdTdT | 2725 |
| AD-62003.1 | CGAUGUUUCUUACAAGCAUdTdT | 2159 | 3969-3987 | AUGCUUGUAAGAAACAUCGdTdT | 2726 |
| AD-62009.1 | CAAGCAUAAAGGUGCCUUAdTdT | 2160 | 3981-3999 | UAAGGCACCUUUAUGCUUGdTdT | 2727 |
| AD-62056.1 | GUGCCUUACAUAAUUAUAAdTdT | 2161 | 3992-4010 | UUAUAAUUAUGUAAGGCACdTdT | 2728 |
| AD-62015.1 | ACAUAAUUAUAAAAUGACAdTdT | 2162 | 3999-4017 | UGUCAUUUUAUAAUUAUGUdTdT | 2729 |
| AD-62021.1 | AAAUGACAGACAAGAAUUdTdT | 2163 | 4009-4027 | AAUUCUUGUCUGUCAUUUdTdT | 2730 |
| AD-62027.1 | CAAGAAUUUCCUUGGGAGGdTdT | 2164 | 4020-4038 | CCUCCCAAGGAAAUUCUUGdTdT | 2731 |
| AD-62033.1 | CCUUGGGAGGCCAGUAGAGdTdT | 2165 | 4029-4047 | CUCUACUGGCCUCCCAAGGdTdT | 2732 |
| AD-62039.1 | AGUAGAGGUGCUUCUCAAUdTdT | 2166 | 4041-4059 | AUUGAGAAGCACCUCUACUdTdT | 2733 |
| AD-62045.1 | CUUCUCAAUGAUGACCUCAdTdT | 2167 | 4051-4069 | UGAGGUCAUCAUUGAGAAGdTdT | 2734 |
| AD-62051.1 | UGACCUCAUUGUCAGUACAdTdT | 2168 | 4062-4080 | UGUACUGACAAUGAGGUCAdTdT | 2735 |
| AD-62057.1 | GUCAGUACAGGAUUUGGCAdTdT | 2169 | 4072-4090 | UGCCAAAUCCUGUACUGACdTdT | 2736 |
| AD-62016.1 | AGGAUUUGGCAGUGGCUUGdTdT | 2170 | 4080-4098 | CAAGCCACUGCCAAAUCCUdTdT | 2737 |
| AD-62022.1 | UGGCUUGGCUACAGUACAUdTdT | 2171 | 4092-4110 | AUGUACUGUAGCCAAGCCAdTdT | 2738 |
| AD-62028.1 | GCUACAGUACAUGUAACAAdTdT | 2172 | 4099-4117 | UUGUUACAUGUACUGUAGCdTdT | 2739 |
| AD-62034.1 | AACAACUGUAGUUCACAAAdTdT | 2173 | 4113-4131 | UUUGUGAACUACAGUUGUUdTdT | 2740 |
| AD-62040.1 | GUAGUUCACAAAACCAGUAdTdT | 2174 | 4120-4138 | UACUGGUUUUGUGAACUACdTdT | 2741 |
| AD-62046.1 | AAACCAGUACCUCUGAGGAdTdT | 2175 | 4130-4148 | UCCUCAGAGGUACUGGUUUdTdT | 2742 |
| AD-62052.1 | UGAGGAAGUUUGCAGCUUUdTdT | 2176 | 4143-4161 | AAAGCUGCAAACUUCCUCAdTdT | 2743 |
| AD-62058.1 | UGCAGCUUUUAUUUGAAAAdTdT | 2177 | 4153-4171 | UUUUCAAAUAAAAGCUGCAdTdT | 2744 |
| AD-62017.1 | AUUUGAAAAUCGAUACUCAdTdT | 2178 | 4163-4181 | UGAGUAUCGAUUUUCAAAUdTdT | 2745 |
| AD-62023.1 | CGAUACUCAGGAUAUUGAAdTdT | 2179 | 4173-4191 | UUCAAUAUCCUGAGUAUCGdTdT | 2746 |
| AD-62029.1 | GGAUAUUGAAGCAUCCCACdTdT | 2180 | 4182-4200 | GUGGGAUGCUUCAAUAUCCdTdT | 2747 |
| AD-62035.1 | GAAGCAUCCCACUACAGAGdTdT | 2181 | 4189-4207 | CUCUGUAGUGGGAUGCUUCdTdT | 2748 |
| AD-62041.1 | ACUACAGAGGCUACGGAAAdTdT | 2182 | 4199-4217 | UUUCCGUAGCCUCUGUAGUdTdT | 2749 |
| AD-62047.1 | CGGAAACUCUGAUUACAAAdTdT | 2183 | 4212-4230 | UUUGUAAUCAGAGUUUCCGdTdT | 2750 |
| AD-62053.1 | UGAUUACAAACGCAUAGUAdTdT | 2184 | 4221-4239 | UACUAUGCGUUUGUAAUCAdTdT | 2751 |
| AD-62059.1 | GCAUAGUAGCAUGUGCCAGdTdT | 2185 | 4232-4250 | CUGGCACAUGCUACUAUGCdTdT | 2752 |
| AD-62018.1 | GCAUGUGCCAGCUACAAGCdTdT | 2186 | 4240-4258 | GCUUGUAGCUGGCACAUGCdTdT | 2753 |
| AD-62024.1 | CUACAAGCCCAGCAGGGAAdTdT | 2187 | 4251-4269 | UUCCCUGCUGGGCUUGUAGdTdT | 2754 |
| AD-62030.1 | CAGCAGGGAAGAAUCAUCAdTdT | 2188 | 4260-4278 | UGAUGAUUCUUCCCUGCUGdTdT | 2755 |
| AD-62036.1 | GAAUCAUCAUCUGGAUCCUdTdT | 2189 | 4270-4288 | AGGAUCCAGAUGAUGAUUCdTdT | 2756 |
| AD-62042.1 | GAUCCUCUCAUGCGGUGAUdTdT | 2190 | 4283-4301 | AUCACCGCAUGAGAGGAUCdTdT | 2757 |
| AD-62048.1 | CUCAUGCGGUGAUGGACAUdTdT | 2191 | 4289-4307 | AUGUCCAUCACCGCAUGAGdTdT | 2758 |
| AD-62054.1 | GAUGGACAUCUCCUUGCCUdTdT | 2192 | 4299-4317 | AGGCAAGGAGAUGUCCAUCdTdT | 2759 |
| AD-62060.1 | CUUGCCUACUGGAAUCAGUdTdT | 2193 | 4311-4329 | ACUGAUUCCAGUAGGCAAGdTdT | 2760 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-62019.1 | GAAUCAGUGCAAAUGAAGAdTdT | 2194 | 4322-4340 | UCUUCAUUUGCACUGAUUCdTdT | 2761 |
| AD-62025.1 | AAAUGAAGAAGACUUAAAAdTdT | 2195 | 4332-4350 | UUUUAAGUCUUCUUCAUUUdTdT | 2762 |
| AD-62031.1 | GAAGACUUAAAAGCCCUUGdTdT | 2196 | 4339-4357 | CAAGGGCUUUUAAGUCUUCdTdT | 2763 |
| AD-62037.1 | CCUUGUGGAAGGGGUGGAUdTdT | 2197 | 4353-4371 | AUCCACCCCUUCCACAAGGdTdT | 2764 |
| AD-62043.1 | GAAGGGGUGGAUCAACUAUdTdT | 2198 | 4360-4378 | AUAGUUGAUCCACCCCUUCdTdT | 2765 |
| AD-62049.1 | AUCAACUAUUCACUGAUUAdTdT | 2199 | 4370-4388 | UAAUCAGUGAAUAGUUGAUdTdT | 2766 |
| AD-62055.1 | CACUGAUUACCAAAUCAAAdTdT | 2200 | 4380-4398 | UUUGAUUUGGUAAUCAGUGdTdT | 2767 |
| AD-62061.1 | AUCAAAGAUGGACAUGUUAdTdT | 2201 | 4393-4411 | UAACAUGUCCAUCUUUGAUdTdT | 2768 |
| AD-62020.1 | GGACAUGUUAUUCUGCAACdTdT | 2202 | 4402-4420 | GUUGCAGAAUAACAUGUCCdTdT | 2769 |
| AD-62026.1 | UCUGCAACUGAAUUCGAUUdTdT | 2203 | 4413-4431 | AAUCGAAUUCAGUUGCAGAdTdT | 2770 |
| AD-62032.1 | GAAUUCGAUUCCCUCCAGUdTdT | 2204 | 4422-4440 | ACUGGAGGGAAUCGAAUUCdTdT | 2771 |
| AD-62038.1 | CCCUCCAGUGAUUUCCUUUdTdT | 2205 | 4432-4450 | AAAGGAAAUCACUGGAGGGdTdT | 2772 |
| AD-62044.1 | GAUUUCCUUUGUGUACGAUdTdT | 2206 | 4441-4459 | AUCGUACACAAAGGAAAUCdTdT | 2773 |
| AD-62050.1 | GUACGAUUCCGGAUAUUUGdTdT | 2207 | 4453-4471 | CAAAUAUCCGGAAUCGUACdTdT | 2774 |
| AD-62320.1 | CGGAUAUUUGAACUCUUUGdTdT | 2208 | 4462-4480 | CAAAGAGUUCAAAUAUCCGdTdT | 2775 |
| AD-62326.1 | ACUCUUUGAAGUUGGGUUUdTdT | 2209 | 4473-4491 | AAACCCAACUUCAAAGAGUdTdT | 2776 |
| AD-62332.1 | AGUUGGGUUUCUCAGUCCUdTdT | 2210 | 4482-4500 | AGGACUGAGAAACCCAACUdTdT | 2777 |
| AD-62338.1 | UUCUCAGUCCUGCCACUUUdTdT | 2211 | 4490-4508 | AAAGUGGCAGGACUGAGAAdTdT | 2778 |
| AD-62344.1 | CACUUUCACAGUACGAAUdTdT | 2212 | 4503-4521 | UUCGUACACUGUGAAAGUGdTdT | 2779 |
| AD-62350.1 | CACAGUGUACGAAUACCACdTdT | 2213 | 4509-4527 | GUGGUAUUCGUACACUGUGdTdT | 2780 |
| AD-62356.1 | ACCACAGACCAGAUAAACdTdT | 2214 | 4523-4541 | UGUUUAUCUGGUCUGUGGUdTdT | 2781 |
| AD-62362.1 | CCAGAUAAACAGUGUACCAdTdT | 2215 | 4531-4549 | UGGUACACUGUUUAUCUGGdTdT | 2782 |
| AD-62321.1 | CAGUGUACCAUGUUUUAUAdTdT | 2216 | 4540-4558 | UAUAAAACAUGGUACACUGdTdT | 2783 |
| AD-62327.1 | GUUUUAUAGCACUUCCAAUdTdT | 2217 | 4551-4569 | AUUGGAAGUGCUAUAAAACdTdT | 2784 |
| AD-62333.1 | CUUCCAAUAUCAAAAUUCAdTdT | 2218 | 4562-4580 | UGAAUUUUGAUAUUGGAAGdTdT | 2785 |
| AD-62339.1 | AUCAAAAUUCAGAAAGUCUdTdT | 2219 | 4570-4588 | AGACUUUCUGAAUUUUGAUdTdT | 2786 |
| AD-62345.1 | GAAAGUCUGUGAAGGAGCCdTdT | 2220 | 4581-4599 | GGCUCCUUCACAGACUUUCdTdT | 2787 |
| AD-62351.1 | GAAGGAGCCGCGUGCAAGUdTdT | 2221 | 4591-4609 | ACUUGCACGCGGCUCCUUCdTdT | 2788 |
| AD-62357.1 | CGUGCAAGUGUGUAGAAGCdTdT | 2222 | 4601-4619 | GCUUCUACACACUUGCACGdTdT | 2789 |
| AD-62363.1 | GUAGAAGCUGAUUGUGGGCdTdT | 2223 | 4612-4630 | GCCCACAAUCAGCUUCUACdTdT | 2790 |
| AD-62322.1 | CUGAUUGUGGGCAAAUGCAdTdT | 2224 | 4619-4637 | UGCAUUUGCCCACAAUCAGdTdT | 2791 |
| AD-62328.1 | GCAAAUGCAGGAAGAAUUGdTdT | 2225 | 4629-4647 | CAAUUCUUCCUGCAUUUGCdTdT | 2792 |
| AD-62334.1 | GAAGAAUUGGAUCUGACAAdTdT | 2226 | 4639-4657 | UUGUCAGAUCCAAUUCUUCdTdT | 2793 |
| AD-62340.1 | CUGACAAUCUCUGCAGAGAdTdT | 2227 | 4651-4669 | UCUCUGCAGAGAUUGUCAGdTdT | 2794 |
| AD-62346.1 | GCAGAGACAAGAAAACAAAdTdT | 2228 | 4663-4681 | UUUGUUUUCUUGUCUCUGCdTdT | 2795 |
| AD-62352.1 | CAAGAAAACAAACAGCAUGdTdT | 2229 | 4670-4688 | CAUGCUGUUUGUUUUCUUGdTdT | 2796 |
| AD-62358.1 | ACAGCAUGUAAACCAGAGAdTdT | 2230 | 4681-4699 | UCUCUGGUUUACAUGCUGUdTdT | 2797 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-62364.1 | CCAGAGAUUGCAUAUGCUUdTdT | 2231 | 4693-4711 | AAGCAUAUGCAAUCUCUGGdTdT | 2798 |
| AD-62323.1 | GCAUAUGCUUAUAAAGUUAdTdT | 2232 | 4702-4720 | UAACUUUAUAAGCAUAUGCdTdT | 2799 |
| AD-62329.1 | UUAUAAAGUUAGCAUCACAdTdT | 2233 | 4710-4728 | UGUGAUGCUAACUUUAUAAdTdT | 2800 |
| AD-62335.1 | CAUCACAUCCAUCACUGUAdTdT | 2234 | 4722-4740 | UACAGUGAUGGAUGUGAUGdTdT | 2801 |
| AD-62341.1 | UCACUGUAGAAAAUGUUUUdTdT | 2235 | 4733-4751 | AAAACAUUUUCUACAGUGAdTdT | 2802 |
| AD-62347.1 | AGAAAAUGUUUUUGUCAAGdTdT | 2236 | 4740-4758 | CUUGACAAAAACAUUUUCUdTdT | 2803 |
| AD-62353.1 | UUUGUCAAGUACAAGGCAAdTdT | 2237 | 4750-4768 | UUGCCUUGUACUUGACAAAdTdT | 2804 |
| AD-62359.1 | AGGCAACCCUUCUGGAUAUdTdT | 2238 | 4763-4781 | AUAUCCAGAAGGGUUGCCUdTdT | 2805 |
| AD-62365.1 | CCUUCUGGAUAUCUACAAAdTdT | 2239 | 4770-4788 | UUUGUAGAUAUCCAGAGGdTdT | 2806 |
| AD-62324.1 | UAUCUACAAAACUGGGGAAdTdT | 2240 | 4779-4797 | UUCCCCAGUUUUGUAGAUAdTdT | 2807 |
| AD-62330.1 | CUGGGGAAGCUGUUGCUGAdTdT | 2241 | 4790-4808 | UCAGCAACAGCUUCCCCAGdTdT | 2808 |
| AD-62336.1 | CUGUUGCUGAGAAAGACUCdTdT | 2242 | 4799-4817 | GAGUCUUUCUCAGCAACAGdTdT | 2809 |
| AD-62342.1 | GACUCUGAGAUUACCUUCAdTdT | 2243 | 4813-4831 | UGAAGGUAAUCUCAGAGUCdTdT | 2810 |
| AD-62348.1 | GAGAUUACCUUCAUUAAAAdTdT | 2244 | 4819-4837 | UUUUAAUGAAGGUAAUCUCdTdT | 2811 |
| AD-62354.1 | AUUAAAAGGUAACCUGUAdTdT | 2245 | 4831-4849 | UACAGGUUACCUUUUUAAUdTdT | 2812 |
| AD-62360.1 | UAACCUGUACUAACGCUGAdTdT | 2246 | 4841-4859 | UCAGCGUUAGUACAGGUUAdTdT | 2813 |
| AD-62366.1 | CUAACGCUGAGCUGGUAAAdTdT | 2247 | 4850-4868 | UUUACCAGCUCAGCGUUAGdTdT | 2814 |
| AD-62325.1 | GGUAAAAGGAAGACAGUACdTdT | 2248 | 4863-4881 | GUACUGUCUUCCUUUUACCdTdT | 2815 |
| AD-62331.1 | GAAGACAGUACUUAAUUAUdTdT | 2249 | 4871-4889 | AUAAUUAAGUACUGUCUUCdTdT | 2816 |
| AD-62337.1 | CUUAAUUAUGGGUAAAGAAdTdT | 2250 | 4881-4899 | UUCUUUACCCAUAAUUAAGdTdT | 2817 |
| AD-62343.1 | UAAAGAAGCCCUCCAGAUAdTdT | 2251 | 4893-4911 | UAUCUGGAGGGCUUCUUUAdTdT | 2818 |
| AD-62349.1 | CCUCCAGAUAAAAUACAAUdTdT | 2252 | 4902-4920 | AUUGUAUUUUAUCUGGAGGdTdT | 2819 |
| AD-62355.1 | AAAUACAAUUUCAGUUUCAdTdT | 2253 | 4912-4930 | UGAAACUGAAAUUGUAUUUdTdT | 2820 |
| AD-62361.1 | CAGUUUCAGGUACAUCUACdTdT | 2254 | 4923-4941 | GUAGAUGUACCUGAAACUGdTdT | 2821 |
| AD-62367.1 | GGUACAUCUACCCUUUAGAdTdT | 2255 | 4931-4949 | UCUAAAGGGUAGAUGUACCdTdT | 2822 |
| AD-62373.1 | CCUUUAGAUUCCUUGACCUdTdT | 2256 | 4942-4960 | AGGUCAAGGAAUCUAAAGGdTdT | 2823 |
| AD-62379.1 | CCUUGACCUGGAUUGAAUAdTdT | 2257 | 4952-4970 | UAUUCAAUCCAGGUCAAGGdTdT | 2824 |
| AD-62385.1 | GGAUUGAAUACUGGCCUAGdTdT | 2258 | 4961-4979 | CUAGGCCAGUAUUCAAUCCdTdT | 2825 |
| AD-62391.1 | CUGGCCUAGAGACACAACAdTdT | 2259 | 4971-4989 | UGUUGUGUCUCUAGGCCAGdTdT | 2826 |
| AD-62397.1 | GAGACACAACAUGUUCAUCdTdT | 2260 | 4979-4997 | GAUGAACAUGUUGUGUCUCdTdT | 2827 |
| AD-62403.1 | GUUCAUCGUGUCAAGCAUUdTdT | 2261 | 4991-5009 | AAUGCUUGACACGAUGAACdTdT | 2828 |
| AD-62409.1 | GUCAAGCAUUUUUAGCUAAdTdT | 2262 | 5000-5018 | UUAGCUAAAAAUGCUUGACdTdT | 2829 |
| AD-62368.1 | AGCUAAUUUAGAUGAAUUUdTdT | 2263 | 5013-5031 | AAAUUCAUCUAAAUUAGCUdTdT | 2830 |
| AD-62374.1 | AGAUGAAUUUGCCGAAGAUdTdT | 2264 | 5022-5040 | AUCUUCGGCAAAUUCAUCUdTdT | 2831 |
| AD-62380.1 | CCGAAGAUAUCUUUUUAAAdTdT | 2265 | 5033-5051 | UUUAAAAAGAUAUCUUCGGdTdT | 2832 |
| AD-62386.1 | CUUUUUAAAUGGAUGCUAAdTdT | 2266 | 5043-5061 | UUAGCAUCCAUUUAAAAAGdTdT | 2833 |
| AD-62392.1 | GGAUGCUAAAAUUCCUGAAdTdT | 2267 | 5053-5071 | UUCAGGAAUUUUAGCAUCCdTdT | 2834 |
| AD-62398.1 | UAAAAUUCCUGAAGUUCAGdTdT | 2268 | 5059-5077 | CUGAACUUCAGGAAUUUUAdTdT | 2835 |

TABLE 21-continued dT Modified C5 iRNAs

| Duplex ID | Sense Sequence | SEQ ID NO: | Position in NM_001735.2 | Antisense Sequence | SEQ ID NO: |
|---|---|---|---|---|---|
| AD-62404.1 | AGUUCAGCUGCAUACAGUUdTdT | 2269 | 5071-5089 | AACUGUAUGCAGCUGAACUdTdT | 2836 |
| AD-62410.1 | GCAUACAGUUUGCACUUAUdTdT | 2270 | 5080-5098 | AUAAGUGCAAACUGUAUGCdTdT | 2837 |
| AD-62369.1 | ACUUAUGGACUCCUGUUGUdTdT | 2271 | 5093-5111 | ACAACAGGAGUCCAUAAGUdTdT | 2838 |
| AD-62375.1 | GGACUCCUGUUGUUGAAGUdTdT | 2272 | 5099-5117 | ACUUCAACAACAGGAGUCCdTdT | 2839 |
| AD-62381.1 | UGUUGAAGUUCGUUUUUUUdTdT | 2273 | 5109-5127 | AAAAAAACGAACUUCAACAdTdT | 2840 |
| AD-62387.1 | UUUUUUGUUUUCUUCUUUUdTdT | 2274 | 5122-5140 | AAAAGAAGAAAACAAAAAAdTdT | 2841 |
| AD-62393.1 | UCUUCUUUUUUUAAACAUUdTdT | 2275 | 5132-5150 | AAUGUUUAAAAAAGAAGAdTdT | 2842 |
| AD-62399.1 | UUUUUAAACAUUCAUAGCUdTdT | 2276 | 5139-5157 | AGCUAUGAAUGUUUAAAAAdTdT | 2843 |
| AD-62405.1 | AUAGCUGGUCUUAUUUGUdTdT | 2277 | 5152-5170 | UACAAAUAAGACCAGCUAUdTdT | 2844 |
| AD-62411.1 | GUCUUAUUUGUAAAGCUCAdTdT | 2278 | 5159-5177 | UGAGCUUUACAAAUAAGACdTdT | 2845 |
| AD-62370.1 | AAAGCUCACUUUACUUAGAdTdT | 2279 | 5170-5188 | UCUAAGUAAAGUGAGCUUUdTdT | 2846 |
| AD-62376.1 | ACUUAGAAUUAGUGGCACUdTdT | 2280 | 5182-5200 | AGUGCCACUAAUUCUAAGUdTdT | 2847 |
| AD-62382.1 | AGUGGCACUUGCUUUUAUUdTdT | 2281 | 5192-5210 | AAUAAAAGCAAGUGCCACUdTdT | 2848 |
| AD-62388.1 | GCUUUUAUUAGAGAAUGAUdTdT | 2282 | 5202-5220 | AUCAUUCUCUAAUAAAAGCdTdT | 2849 |
| AD-62394.1 | GAGAAUGAUUUCAAAUGCUdTdT | 2283 | 5212-5230 | AGCAUUUGAAAUCAUUCUCdTdT | 2850 |
| AD-62400.1 | UUUCAAAUGCUGUAACUUUdTdT | 2284 | 5220-5238 | AAAGUUACAGCAUUUGAAAdTdT | 2851 |
| AD-62406.1 | GUAACUUUCUGAAAUAACAdTdT | 2285 | 5231-5249 | UGUUAUUUCAGAAAGUUACdTdT | 2852 |
| AD-62412.1 | GAAAUAACAUGGCCUUGGAdTdT | 2286 | 5241-5259 | UCCAAGGCCAUGUUAUUUCdTdT | 2853 |
| AD-62371.1 | CCUUGGAGGGCAUGAAGACdTdT | 2287 | 5253-5271 | GUCUUCAUGCCCUCCAAGGdTdT | 2854 |
| AD-62377.1 | AGGGCAUGAAGACAGAUACdTdT | 2288 | 5259-5277 | GUAUCUGUCUUCAUGCCCUdTdT | 2855 |
| AD-62383.1 | GAUACUCCUCCAAGGUUAUdTdT | 2289 | 5273-5291 | AUAACCUUGGAGGAGUAUCdTdT | 2856 |
| AD-62389.1 | CCUCCAAGGUUAUUGGACAdTdT | 2290 | 5279-5297 | UGUCCAAUAACCUUGGAGGdTdT | 2857 |
| AD-62395.1 | GGACACCGGAAACAAUAAAdTdT | 2291 | 5293-5311 | UUUAUUGUUUCCGGUGUCCdTdT | 2858 |
| AD-62401.1 | GAAACAAUAAAUUGGAACAdTdT | 2292 | 5301-5319 | UGUUCCAAUUUAUUGUUUCdTdT | 2859 |
| AD-62407.1 | AUUGGAACACCUCCUCAAAdTdT | 2293 | 5311-5329 | UUUGAGGAGGUGUUCCAAUdTdT | 2860 |
| AD-62413.1 | UCCUCAAACCUACCACUCAdTdT | 2294 | 5322-5340 | UGAGUGGUAGGUUUGAGGAdTdT | 2861 |
| AD-62372.1 | CUACCACUCAGGAAUGUUUdTdT | 2295 | 5331-5349 | AAACAUUCCUGAGUGGUAGdTdT | 2862 |
| AD-62378.1 | AAUGUUUGCUGGGGCCGAAdTdT | 2296 | 5343-5361 | UUCGGCCCCAGCAAACAUUdTdT | 2863 |
| AD-62384.1 | UGCUGGGGCCGAAAGAACAdTdT | 2297 | 5349-5367 | UGUUCUUUCGGCCCCAGCAdTdT | 2864 |
| AD-62390.1 | AAAGAACAGUCCAUUGAAAdTdT | 2298 | 5360-5378 | UUUCAAUGGACUGUUCUUUdTdT | 2865 |
| AD-62396.1 | CAUUGAAAGGGAGUAUUACdTdT | 2299 | 5371-5389 | GUAAUACUCCCUUUCAAUGdTdT | 2866 |
| AD-62402.1 | GGAGUAUUACAAAAACAUGdTdT | 2300 | 5380-5398 | CAUGUUUUGUAAUACUCCdTdT | 2867 |
| AD-62408.1 | AAAACAUGGCCUUUGCUUGdTdT | 2301 | 5391-5409 | CAAGCAAAGGCCAUGUUUUdTdT | 2868 |
| AD-62414.1 | GCCUUUGCUUGAAAGAAAAdTdT | 2302 | 5399-5417 | UUUUCUUUCAAGCAAAGGCdTdT | 2869 |
| AD-62415.1 | GAAAGAAAAUACCAAGGAAdTdT | 2303 | 5409-5427 | UUCCUUGGUAUUUUCUUUCdTdT | 2870 |
| AD-62416.1 | CCAAGGAACAGGAAACUGAdTdT | 2304 | 5420-5438 | UCAGUUUCCUGUUCCUUGGdTdT | 2871 |
| AD-62417.1 | AACUGAUCAUUAAAGCCUGdTdT | 2305 | 5433-5451 | CAGGCUUUAAUGAUCAGUUdTdT | 2872 |

TABLE 22

C5 single dose screen (10 mM) in Hep3B cells with dT modified iRNAs

| Duplex ID | Avg. % message remaining |
|---|---|
| AD-61779.2 | 43.2 |
| AD-61785.2 | 22.5 |
| AD-61791.2 | 27.3 |
| AD-61797.2 | 30.5 |
| AD-61803.2 | 30.9 |
| AD-61809.2 | 75.1 |
| AD-61815.2 | 90.7 |
| AD-61821.2 | 33.7 |
| AD-61780.2 | 53.5 |
| AD-61786.2 | 34.4 |
| AD-61792.2 | 27.5 |
| AD-61798.2 | 23.3 |
| AD-61804.2 | 23.6 |
| AD-61810.2 | 33.4 |
| AD-61816.2 | 39.7 |
| AD-61822.2 | 24.9 |
| AD-61781.2 | 31.2 |
| AD-61787.2 | 22.8 |
| AD-61793.2 | 28.4 |
| AD-61799.2 | 91 |
| AD-61805.2 | 22.1 |
| AD-61811.2 | 90.9 |
| AD-61817.2 | 26.1 |
| AD-61823.2 | 41.3 |
| AD-61782.2 | 42.5 |
| AD-61788.2 | 28.9 |
| AD-61794.2 | 133.5 |
| AD-61800.2 | 27.9 |
| AD-61806.2 | 42.8 |
| AD-61812.2 | 26.9 |
| AD-61818.2 | 30.6 |
| AD-61824.2 | 29.3 |
| AD-61783.2 | 61.3 |
| AD-61789.2 | 25.5 |
| AD-61795.2 | 34.2 |
| AD-61801.2 | 24.2 |
| AD-61807.2 | 42.8 |
| AD-61813.2 | 31 |
| AD-61819.2 | 42.2 |
| AD-61825.2 | 31 |
| AD-61784.2 | 34.1 |
| AD-61790.2 | 26.8 |
| AD-61796.2 | 34.6 |
| AD-61802.2 | 30 |
| AD-61808.2 | 23.5 |
| AD-61814.2 | 45.3 |
| AD-61820.2 | 56 |
| AD-61826.2 | 31.6 |
| AD-61832.2 | 36.2 |
| AD-61838.2 | 39.7 |
| AD-61844.2 | 37 |
| AD-61850.2 | 66.3 |
| AD-61856.2 | 172.6 |
| AD-61862.2 | 41.3 |
| AD-61868.2 | 32.2 |
| AD-61827.2 | 52.7 |
| AD-61833.2 | 29.6 |
| AD-61839.2 | 41.5 |
| AD-61845.2 | 29.7 |
| AD-61851.2 | 37 |
| AD-61857.2 | 34.9 |
| AD-61863.2 | 33.3 |
| AD-61869.2 | 38.2 |
| AD-61828.2 | 30.3 |
| AD-61834.2 | 27.1 |
| AD-61840.2 | 64.3 |
| AD-61846.2 | 42 |
| AD-61852.2 | 25.2 |
| AD-61858.2 | 96.7 |
| AD-61864.2 | 29.6 |
| AD-61870.2 | 30.5 |
| AD-61829.2 | 92.7 |
| AD-61835.2 | 24.8 |
| AD-61841.2 | 59.2 |
| AD-61847.2 | 30.9 |
| AD-61853.2 | 35.2 |
| AD-61859.2 | 40.1 |
| AD-61865.2 | 42.3 |
| AD-61871.2 | 55.8 |
| AD-61830.2 | 162.9 |
| AD-61836.2 | 28.8 |
| AD-61842.2 | 18.2 |
| AD-61848.2 | 25 |
| AD-61854.2 | 42.3 |
| AD-61860.2 | 41.7 |
| AD-61866.2 | 28.9 |
| AD-61872.2 | 64.7 |
| AD-61831.2 | 16.9 |
| AD-61837.2 | 24.9 |
| AD-61843.2 | 27.5 |
| AD-61849.2 | 25.8 |
| AD-61855.2 | 20 |
| AD-61861.2 | 28.6 |
| AD-61867.2 | 18 |
| AD-62062.1 | 22 |
| AD-62068.1 | 29.9 |
| AD-62074.1 | 40.2 |
| AD-62080.1 | 30.4 |
| AD-62086.1 | 21 |
| AD-62092.1 | 20 |
| AD-62098.1 | 38.4 |
| AD-62104.1 | 42.7 |
| AD-62063.1 | 26.6 |
| AD-62069.1 | 55.6 |
| AD-62075.1 | 114.4 |
| AD-62081.1 | 21.2 |
| AD-62087.1 | 33.8 |
| AD-62093.1 | 26.3 |
| AD-62099.1 | 23.9 |
| AD-62105.1 | 30.1 |
| AD-62064.1 | 32 |
| AD-62070.1 | 135.7 |
| AD-62076.1 | 84.3 |
| AD-62082.1 | 42.3 |
| AD-62088.1 | 36.5 |
| AD-62094.1 | 66 |
| AD-62100.1 | 66.4 |
| AD-62106.1 | 33.9 |
| AD-62065.1 | 33 |
| AD-62071.1 | 38.4 |
| AD-62077.1 | 27.8 |
| AD-62083.1 | 44.7 |
| AD-62089.1 | 42.7 |
| AD-62095.1 | 46.6 |
| AD-62101.1 | 35.3 |
| AD-62107.1 | 29.9 |
| AD-62066.1 | 33.5 |
| AD-62072.1 | 27.5 |
| AD-62078.1 | 49.9 |
| AD-62084.1 | 117.6 |
| AD-62090.1 | 44 |
| AD-62096.1 | 33.5 |
| AD-62102.1 | 39.2 |
| AD-62108.1 | 69.5 |
| AD-62067.1 | 32.3 |
| AD-62073.1 | 81.1 |
| AD-62079.1 | 46.8 |
| AD-62085.1 | 31.6 |
| AD-62091.1 | 32 |
| AD-62097.1 | 35.3 |
| AD-62103.1 | 35.6 |
| AD-62109.1 | 24.7 |
| AD-62115.1 | 25.7 |
| AD-62121.1 | 23.1 |
| AD-62127.1 | 36.3 |
| AD-62133.1 | 50.9 |
| AD-62139.1 | 84.1 |
| AD-62145.1 | 90.8 |
| AD-62151.1 | 56.9 |
| AD-62110.1 | 26 |
| AD-62116.1 | 145.5 |
| AD-62122.1 | 198.7 |

TABLE 22-continued

C5 single dose screen (10 mM) in Hep3B cells with dT modified iRNAs

| Duplex ID | Avg. % message remaining |
|---|---|
| AD-62128.1 | 178.4 |
| AD-62134.1 | 52.4 |
| AD-62140.1 | 55.6 |
| AD-62146.1 | 47.2 |
| AD-62152.1 | 16.4 |
| AD-62111.1 | 49.3 |
| AD-62117.1 | 46.2 |
| AD-62123.1 | 95.1 |
| AD-62129.1 | 156.2 |
| AD-62135.1 | 62 |
| AD-62141.1 | 128.1 |
| AD-62147.1 | 146.2 |
| AD-62153.1 | 35.5 |
| AD-62112.1 | 43 |
| AD-62118.1 | 32 |
| AD-62124.1 | 48.4 |
| AD-62130.1 | 49.4 |
| AD-62136.1 | 141.9 |
| AD-62142.1 | 38.7 |
| AD-62148.1 | 165.2 |
| AD-62154.1 | 94.7 |
| AD-62113.1 | 52.5 |
| AD-62119.1 | 44 |
| AD-62125.1 | 129.9 |
| AD-62131.1 | 68.9 |
| AD-62137.1 | 106 |
| AD-62143.1 | 176.1 |
| AD-62149.1 | 201.3 |
| AD-62155.1 | 143.3 |
| AD-62114.1 | 22.8 |
| AD-62120.1 | 34.6 |
| AD-62126.1 | 44.6 |
| AD-62132.1 | 39.5 |
| AD-62138.1 | 34.5 |
| AD-62144.1 | 28 |
| AD-62150.1 | 22.1 |
| AD-62156.1 | 44.1 |
| AD-62162.1 | 19.8 |
| AD-62168.1 | 17.3 |
| AD-62174.1 | 27 |
| AD-62180.1 | 15.8 |
| AD-62186.1 | 20.5 |
| AD-62192.1 | 33.9 |
| AD-62198.1 | 14 |
| AD-62157.1 | 19.3 |
| AD-62163.1 | 15.4 |
| AD-62169.1 | 23.6 |
| AD-62175.1 | 29.6 |
| AD-62181.1 | 26.4 |
| AD-62187.1 | 28.8 |
| AD-62193.1 | 22.9 |
| AD-62199.1 | 16.4 |
| AD-62158.1 | 18.5 |
| AD-62164.1 | 19.1 |
| AD-62170.1 | 15 |
| AD-62176.1 | 62.7 |
| AD-62182.1 | 70.8 |
| AD-62188.1 | 81.1 |
| AD-62194.1 | 63.6 |
| AD-62200.1 | 21.6 |
| AD-62159.1 | 42.8 |
| AD-62165.1 | 27.7 |
| AD-62171.1 | 31.9 |
| AD-62177.1 | 29.6 |
| AD-62183.1 | 25.2 |
| AD-62189.1 | 32.7 |
| AD-62195.1 | 73.1 |
| AD-62201.1 | 35.6 |
| AD-62160.1 | 56.5 |
| AD-62166.1 | 115.1 |
| AD-62172.1 | 107.4 |
| AD-62178.1 | 71.3 |
| AD-62184.1 | 27.2 |
| AD-62190.1 | 37.2 |
| AD-62196.1 | 19.5 |
| AD-62202.1 | 19.4 |
| AD-62161.1 | 23.7 |
| AD-62167.1 | 24.4 |
| AD-62173.1 | 36 |
| AD-62179.1 | 50.5 |
| AD-62185.1 | 40.5 |
| AD-62191.1 | 39.3 |
| AD-62197.1 | 39.4 |
| AD-62203.1 | 34.1 |
| AD-62209.1 | 34.6 |
| AD-62215.1 | 31 |
| AD-62221.1 | 16.3 |
| AD-62227.1 | 68.5 |
| AD-62233.1 | 34.3 |
| AD-62239.1 | 37.2 |
| AD-62245.1 | 31.2 |
| AD-62204.1 | 33 |
| AD-62210.1 | 29 |
| AD-62216.1 | 38.7 |
| AD-62222.1 | 34.5 |
| AD-62228.1 | 30.3 |
| AD-62234.1 | 15.2 |
| AD-62240.1 | 26.2 |
| AD-62246.1 | 40.4 |
| AD-62205.1 | 17.1 |
| AD-62211.1 | 20.9 |
| AD-62217.1 | 49.8 |
| AD-62223.1 | 40 |
| AD-62229.1 | 26.7 |
| AD-62235.1 | 21.5 |
| AD-62241.1 | 46.2 |
| AD-62247.1 | 40.4 |
| AD-62206.1 | 42.2 |
| AD-62212.1 | 51.7 |
| AD-62218.1 | 26 |
| AD-62224.1 | 40.3 |
| AD-62230.1 | 32.8 |
| AD-62236.1 | 52.4 |
| AD-62242.1 | 33.1 |
| AD-62248.1 | 18 |
| AD-62207.1 | 19.7 |
| AD-62213.1 | 43.4 |
| AD-62219.1 | 39.8 |
| AD-62225.1 | 34.3 |
| AD-62231.1 | 37.2 |
| AD-62237.1 | 25.9 |
| AD-62243.1 | 19.8 |
| AD-62249.1 | 13.8 |
| AD-62208.1 | 13.7 |
| AD-62214.1 | 16.6 |
| AD-62220.1 | 25.2 |
| AD-62226.1 | 27 |
| AD-62232.1 | 36.5 |
| AD-62238.1 | 51.5 |
| AD-62244.1 | 31.5 |
| AD-61874.1 | 27.1 |
| AD-61880.1 | 30.8 |
| AD-61886.1 | 30.4 |
| AD-61892.1 | 48.9 |
| AD-61898.1 | 24.7 |
| AD-61904.1 | 125.9 |
| AD-61910.1 | 45.7 |
| AD-61916.1 | 25.7 |
| AD-61875.1 | 33.4 |
| AD-61881.1 | 64 |
| AD-61887.1 | 36.7 |
| AD-61893.1 | 22.9 |
| AD-61899.1 | 84.5 |
| AD-61905.1 | 32.1 |
| AD-61911.1 | 23.7 |
| AD-61917.1 | 22.1 |
| AD-61876.1 | 47.3 |
| AD-61882.1 | 26.5 |
| AD-61888.1 | 27.7 |
| AD-61894.1 | 64.8 |
| AD-61900.1 | 89.8 |
| AD-61906.1 | 22.4 |

TABLE 22-continued

C5 single dose screen (10 mM) in Hep3B cells with dT modified iRNAs

| Duplex ID | Avg. % message remaining |
| --- | --- |
| AD-61912.1 | 19.8 |
| AD-61918.1 | 37.1 |
| AD-61877.1 | 145 |
| AD-61883.1 | 31.5 |
| AD-61889.1 | 33.9 |
| AD-61895.1 | 37.5 |
| AD-61901.1 | 26.1 |
| AD-61907.1 | 33 |
| AD-61913.1 | 33.1 |
| AD-61919.1 | 36.6 |
| AD-61878.1 | 26.9 |
| AD-61884.1 | 33.9 |
| AD-61890.1 | 37.2 |
| AD-61896.1 | 41.7 |
| AD-61902.1 | 58.6 |
| AD-61908.1 | 28 |
| AD-61914.1 | 31.4 |
| AD-61920.1 | 27.1 |
| AD-61879.1 | 33.1 |
| AD-61885.1 | 33.7 |
| AD-61891.1 | 41.3 |
| AD-61897.1 | 39.4 |
| AD-61903.1 | 51.5 |
| AD-61909.1 | 48.6 |
| AD-61915.1 | 122.4 |
| AD-61921.1 | 66.4 |
| AD-61927.1 | 40.5 |
| AD-61933.1 | 27.7 |
| AD-61939.1 | 28.1 |
| AD-61945.1 | 30 |
| AD-61951.1 | 33.7 |
| AD-61957.1 | 32.6 |
| AD-61963.1 | 17 |
| AD-61922.1 | 32.9 |
| AD-61928.1 | 28.3 |
| AD-61934.1 | 24 |
| AD-61940.1 | 28.2 |
| AD-61946.1 | 33.2 |
| AD-61952.1 | 167.9 |
| AD-61958.1 | 37 |
| AD-61964.1 | 30.6 |
| AD-61923.1 | 51.2 |
| AD-61929.1 | 29.4 |
| AD-61935.1 | 61 |
| AD-61941.1 | 29.5 |
| AD-61947.1 | 28.9 |
| AD-61953.1 | 23.7 |
| AD-61959.1 | 18.9 |
| AD-61965.1 | 17 |
| AD-61924.1 | 24.1 |
| AD-61930.1 | 31.9 |
| AD-61936.1 | 36.9 |
| AD-61942.1 | 13.8 |
| AD-61948.1 | 40.2 |
| AD-61954.1 | 41.8 |
| AD-61960.1 | 24.1 |
| AD-61966.1 | 18.9 |
| AD-61925.1 | 52.4 |
| AD-61931.1 | 25.8 |
| AD-61937.1 | 19.1 |
| AD-61943.1 | 27.8 |
| AD-61949.1 | 26.5 |
| AD-61955.1 | 83.8 |
| AD-61961.1 | 26 |
| AD-61967.1 | 16.3 |
| AD-61926.1 | 17.8 |
| AD-61932.1 | 18.6 |
| AD-61938.1 | 31.9 |
| AD-61944.1 | 29.5 |
| AD-61950.1 | 57.8 |
| AD-61956.1 | 42.1 |
| AD-61962.1 | 30 |
| AD-61968.1 | 29.1 |
| AD-61974.1 | 50.8 |
| AD-61980.1 | 19.7 |
| AD-61986.1 | 36.4 |
| AD-61992.1 | 36.3 |
| AD-61998.1 | 18.3 |
| AD-62004.1 | 14 |
| AD-62010.1 | 56.8 |
| AD-61969.1 | 30 |
| AD-61975.1 | 51.1 |
| AD-61981.1 | 37.6 |
| AD-61987.1 | 32.5 |
| AD-61993.1 | 23.4 |
| AD-61999.1 | 43.8 |
| AD-62005.1 | 23.8 |
| AD-62011.1 | 32.7 |
| AD-61970.1 | 39.6 |
| AD-61976.1 | 27.5 |
| AD-61982.1 | 64.9 |
| AD-61988.1 | 29.5 |
| AD-61994.1 | 40.5 |
| AD-62006.1 | 42.1 |
| AD-62012.1 | 21 |
| AD-61971.1 | 27.1 |
| AD-61977.1 | 23.4 |
| AD-61983.1 | 57.5 |
| AD-61989.1 | 25.8 |
| AD-61995.1 | 18.2 |
| AD-62001.1 | 29.7 |
| AD-62007.1 | 106.4 |
| AD-62013.1 | 36.1 |
| AD-61972.1 | 40.5 |
| AD-61978.1 | 49.1 |
| AD-61984.1 | 24.3 |
| AD-61990.1 | 38.8 |
| AD-61996.1 | 40.5 |
| AD-62002.1 | 32.5 |
| AD-62008.1 | 35.3 |
| AD-62014.1 | 23.6 |
| AD-61973.1 | 39.3 |
| AD-61979.1 | 27.4 |
| AD-61985.1 | 31.3 |
| AD-61991.1 | 34.9 |
| AD-61997.1 | 29.2 |
| AD-62003.1 | 25.9 |
| AD-62009.1 | 21.1 |
| AD-62056.1 | 16.3 |
| AD-62015.1 | 139.3 |
| AD-62021.1 | 36.4 |
| AD-62027.1 | 42.4 |
| AD-62033.1 | 62 |
| AD-62039.1 | 35.2 |
| AD-62045.1 | 30.8 |
| AD-62051.1 | 22.9 |
| AD-62057.1 | 31.8 |
| AD-62016.1 | 29.2 |
| AD-62022.1 | 36.9 |
| AD-62028.1 | 52.6 |
| AD-62034.1 | 31 |
| AD-62040.1 | 30.7 |
| AD-62046.1 | 28.2 |
| AD-62052.1 | 23.7 |
| AD-62058.1 | 77.9 |
| AD-62017.1 | 41 |
| AD-62023.1 | 27 |
| AD-62029.1 | 31.8 |
| AD-62035.1 | 46.4 |
| AD-62041.1 | 25.3 |
| AD-62047.1 | 20 |
| AD-62053.1 | 37.1 |
| AD-62059.1 | 31 |
| AD-62018.1 | 37.8 |
| AD-62024.1 | 34.7 |
| AD-62030.1 | 50.4 |
| AD-62036.1 | 25.5 |
| AD-62042.1 | 32.5 |
| AD-62048.1 | 28.3 |
| AD-62054.1 | 55.6 |
| AD-62060.1 | 26.9 |
| AD-62019.1 | 29 |

TABLE 22-continued

C5 single dose screen (10 mM) in Hep3B cells with dT modified iRNAs

| Duplex ID | Avg. % message remaining |
|---|---|
| AD-62025.1 | 78.5 |
| AD-62031.1 | 152.8 |
| AD-62037.1 | 27.3 |
| AD-62043.1 | 33.8 |
| AD-62049.1 | 46 |
| AD-62055.1 | 24.5 |
| AD-62061.1 | 30.5 |
| AD-62020.1 | 25.1 |
| AD-62026.1 | 24.9 |
| AD-62032.1 | 23 |
| AD-62038.1 | 21.2 |
| AD-62044.1 | 34.1 |
| AD-62050.1 | 22.4 |
| AD-62320.1 | 16.6 |
| AD-62326.1 | 16.6 |
| AD-62332.1 | 15.4 |
| AD-62338.1 | 41.9 |
| AD-62344.1 | 19.6 |
| AD-62350.1 | 32.3 |
| AD-62356.1 | 20.4 |
| AD-62362.1 | 27.8 |
| AD-62321.1 | 18.7 |
| AD-62327.1 | 14.8 |
| AD-62333.1 | 22.2 |
| AD-62339.1 | 134.5 |
| AD-62345.1 | 32.1 |
| AD-62351.1 | 35.6 |
| AD-62357.1 | 31 |
| AD-62363.1 | 28.2 |
| AD-62322.1 | 45.1 |
| AD-62328.1 | 30.1 |
| AD-62334.1 | 39.1 |
| AD-62340.1 | 24.3 |
| AD-62346.1 | 35.4 |
| AD-62352.1 | 33.8 |
| AD-62358.1 | 45.7 |
| AD-62364.1 | 19.7 |
| AD-62323.1 | 40.5 |
| AD-62329.1 | 57.5 |
| AD-62335.1 | 27.6 |
| AD-62341.1 | 69.2 |
| AD-62347.1 | 125.9 |
| AD-62353.1 | 53.1 |
| AD-62359.1 | 38.1 |
| AD-62365.1 | 23.6 |
| AD-62324.1 | 27.1 |
| AD-62330.1 | 25.1 |
| AD-62336.1 | 25.3 |
| AD-62342.1 | 45.4 |
| AD-62348.1 | 91.6 |
| AD-62354.1 | 132.1 |
| AD-62360.1 | 31.6 |
| AD-62366.1 | 14.2 |
| AD-62325.1 | 27.9 |
| AD-62331.1 | 31.5 |
| AD-62337.1 | 33.9 |
| AD-62343.1 | 36.1 |
| AD-62349.1 | 37.6 |
| AD-62355.1 | 38.8 |
| AD-62361.1 | 46.1 |
| AD-62367.1 | 23.6 |
| AD-62373.1 | 32.1 |
| AD-62379.1 | 29.6 |
| AD-62385.1 | 35.7 |
| AD-62391.1 | 33.7 |
| AD-62397.1 | 54.1 |
| AD-62403.1 | 34.8 |
| AD-62409.1 | 28.2 |
| AD-62368.1 | 29.7 |
| AD-62374.1 | 29.6 |
| AD-62380.1 | 30.6 |
| AD-62386.1 | 23.4 |
| AD-62392.1 | 30.5 |
| AD-62398.1 | 48.7 |
| AD-62404.1 | 24.8 |
| AD-62410.1 | 21.9 |
| AD-62369.1 | 27.4 |
| AD-62375.1 | 31.9 |
| AD-62381.1 | 27.3 |
| AD-62387.1 | 77 |
| AD-62393.1 | 93.3 |
| AD-62399.1 | 150.2 |
| AD-62405.1 | 28.5 |
| AD-62411.1 | 19.4 |
| AD-62370.1 | 16.3 |
| AD-62376.1 | 48.2 |
| AD-62382.1 | 28.5 |
| AD-62388.1 | 49.9 |
| AD-62394.1 | 29.9 |
| AD-62400.1 | 45.2 |
| AD-62406.1 | 23 |
| AD-62412.1 | 45.5 |
| AD-62371.1 | 66.5 |
| AD-62377.1 | 49.5 |
| AD-62383.1 | 73.8 |
| AD-62389.1 | 82.4 |
| AD-62395.1 | 31.8 |
| AD-62401.1 | 31.2 |
| AD-62407.1 | 30.2 |
| AD-62413.1 | 28.1 |
| AD-62372.1 | 43 |
| AD-62378.1 | 17.9 |
| AD-62384.1 | 29.6 |
| AD-62390.1 | 37.7 |
| AD-62396.1 | 26 |
| AD-62402.1 | 31.6 |
| AD-62408.1 | 46.6 |
| AD-62414.1 | 27.2 |
| AD-62415.1 | 17.6 |
| AD-62416.1 | 25.3 |
| AD-62417.1 | 36.3 |
| AD-61779.2 | 43.2 |
| AD-61785.2 | 22.5 |
| AD-61791.2 | 27.3 |
| AD-61797.2 | 30.5 |
| AD-61803.2 | 30.9 |
| AD-61809.2 | 75.1 |
| AD-61815.2 | 90.7 |
| AD-61821.2 | 33.7 |
| AD-61780.2 | 53.5 |
| AD-61786.2 | 34.4 |
| AD-61792.2 | 27.5 |
| AD-61798.2 | 23.3 |
| AD-61804.2 | 23.6 |

Example 7

In Vivo Screening of Additional siRNAs

Based on the sequence of AD-58643, an additional four sense and three antisense sequences were synthesized and used to prepare twelve, 21/25 mer compounds (Table 23). In general, the antisense strands of these compounds were extended with a dTdT and the duplexes had fewer fluoro-modified nucleotides.

C57BL/6 mice (N=3 per group) were injected subcutaneously with 1 mg/kg of these GalNAc conjugated duplexes, serum was collected on day 0 pre-bleed, and day 5, and the levels of C5 proteins were quantified by ELISA. C5 protein levels were normalized to the day 0 pre-bleed level.

Figure 14:
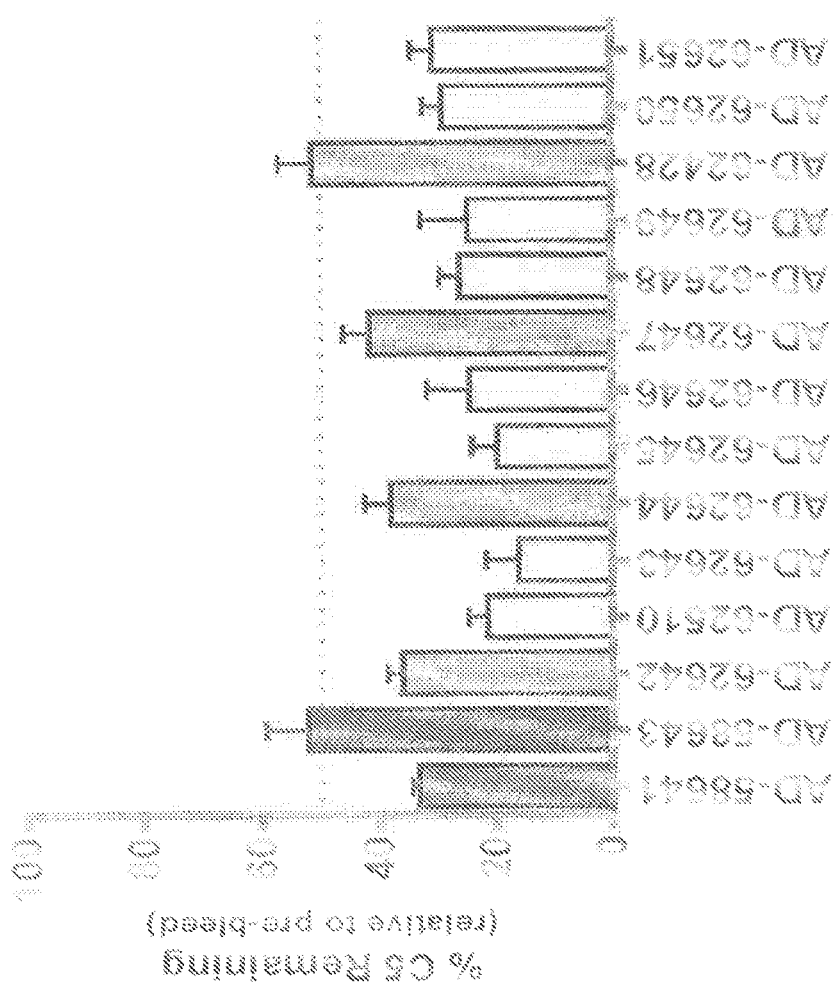
FIG. 14 is a graph showing the percentage of complement component C5 protein remaining at day 5 in the serum of C57BL/6 mice following a single 1 mg/kg dose of the indicated iRNAs.

FIG. 14 shows the results of an in vivo single dose screen with the indicated iRNAs. Data are expressed as percent of C5 protein remaining relative to pre-bleed levels. Those iRNAs having improved efficacy as compared to the parent compound included AD-62510, AD-62643, AD-62645, AD-62646, AD-62650, and AD-62651. These iRNAs also demonstrated similar potencies ($IC_{50}$ of about 23-59 pM).

The efficacy of these iRNAs was also tested in C57Bl/6 mice using a single-dosing administration protocol. Mice were subcutaneously administered AD-62510, AD-62643, AD-62645, AD-62646, AD-62650, and AD-62651 at a 0.25 mg/kg, 0.5 mg/kg, 1.0 mg/kg, or 2.5 mg/kg dose. Serum was collected at days 0 and 5 and analyzed for C5 protein levels by ELISA. C5 levels were normalized to the day 0 pre-bleed level.

Figure 15:
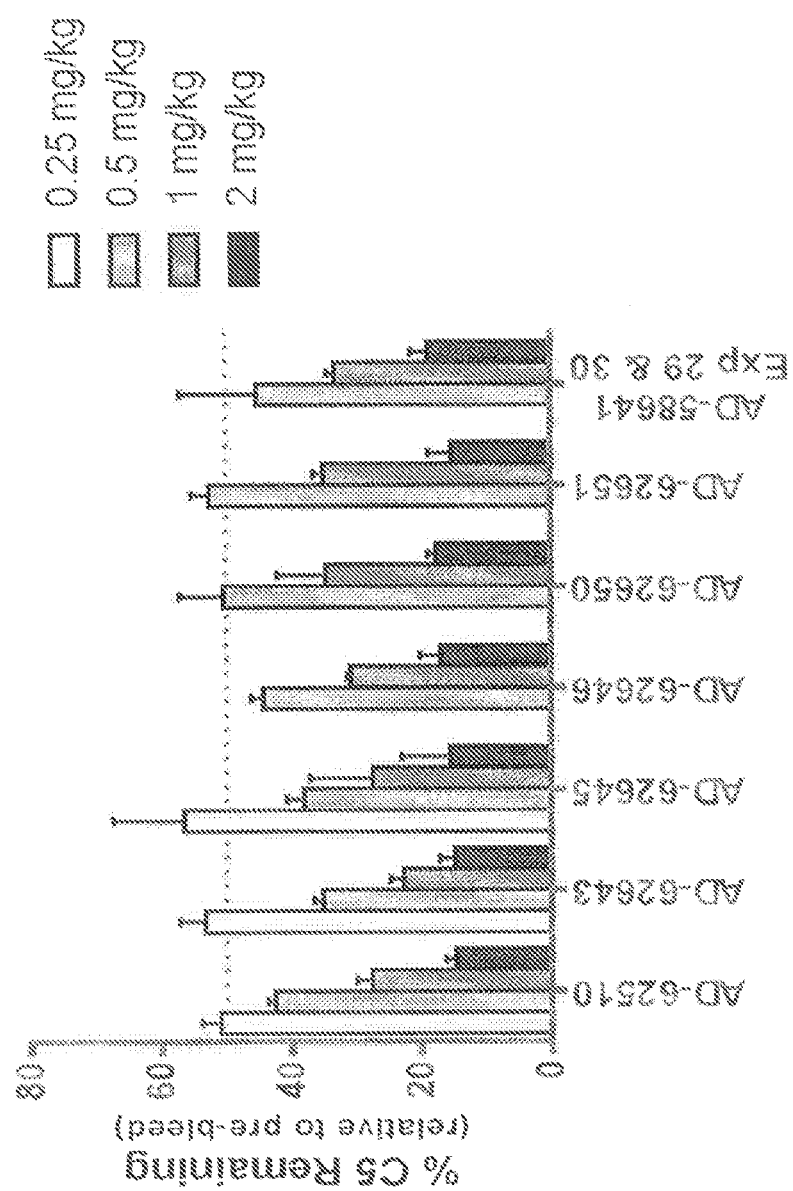
FIG. 15 is a graph showing the percentage of complement component C5 protein remaining at day 5 in the serum of C57BL/6 mice following a single 0.25 mg/kg, 0.5 mg/kg, 1.0 mg/kg, or 2.0 mg/kg dose of the indicated iRNAs.

FIG. 15 shows that there is a dose response with all of the tested iRNAs and that single-dosing of all of these iRNAs achieved silencing of C5 protein similar to or better than AD-58641.

The duration of silencing of AD-62510, AD-62643, AD-62645, AD-62646, AD-62650, and AD-62651 in vivo was determined by administering a single 1.0 mg/kg dose to C57Bl/6 mice and determining the amount of C5 protein present on days 6, 13, 20, 27, and 34 by ELISA. C5 levels were normalized to the day 0 pre-bleed level.

Figure 16:
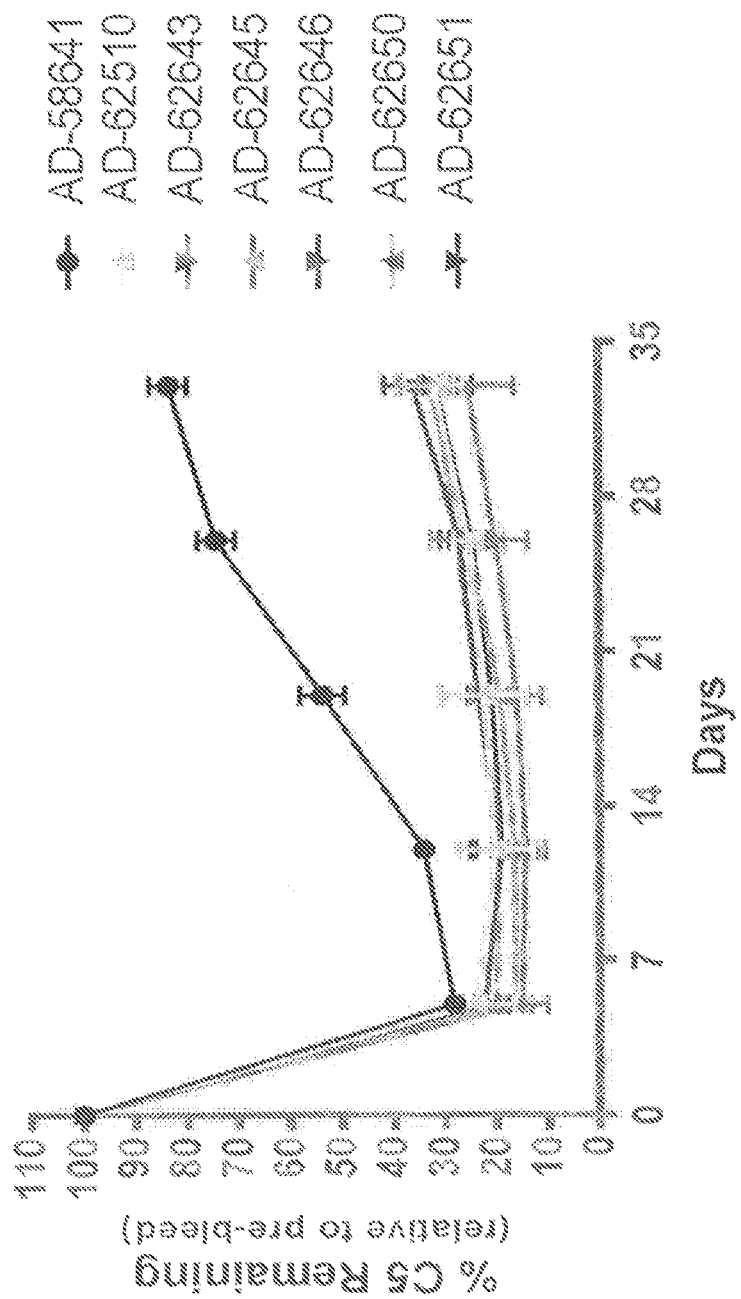
FIG. 16 is a graph showing the percentage of complement component C5 protein remaining in the serum of C57BL/6 mice at days 6, 13, 20, 27, and 34 following a single 1 mg/kg dose of the indicated iRNAs.

As demonstrated in FIG. 16, each of the iRNAs tested has the same recovery kinetics as AD-62643 trending toward the best silencing, but within the error of the assay.

AD-62510, AD-62643, AD-62645, AD-62646, AD-62650, and AD-62651 were further tested for efficacy and to evaluate the cumulative effect of the iRNAs in rats using a repeat administration protocol. Wild-type Sprague Dawley rats were subcutaneously injected with each of the iRNAs at a 5.0 mg/kg/dose on days 0, 4, and 7. Serum was collected on days 0, 4, 7, 11, 14, 18, 25, 28, and 32. Serum hemolytic activity was quantified as described above.

Figure 17:
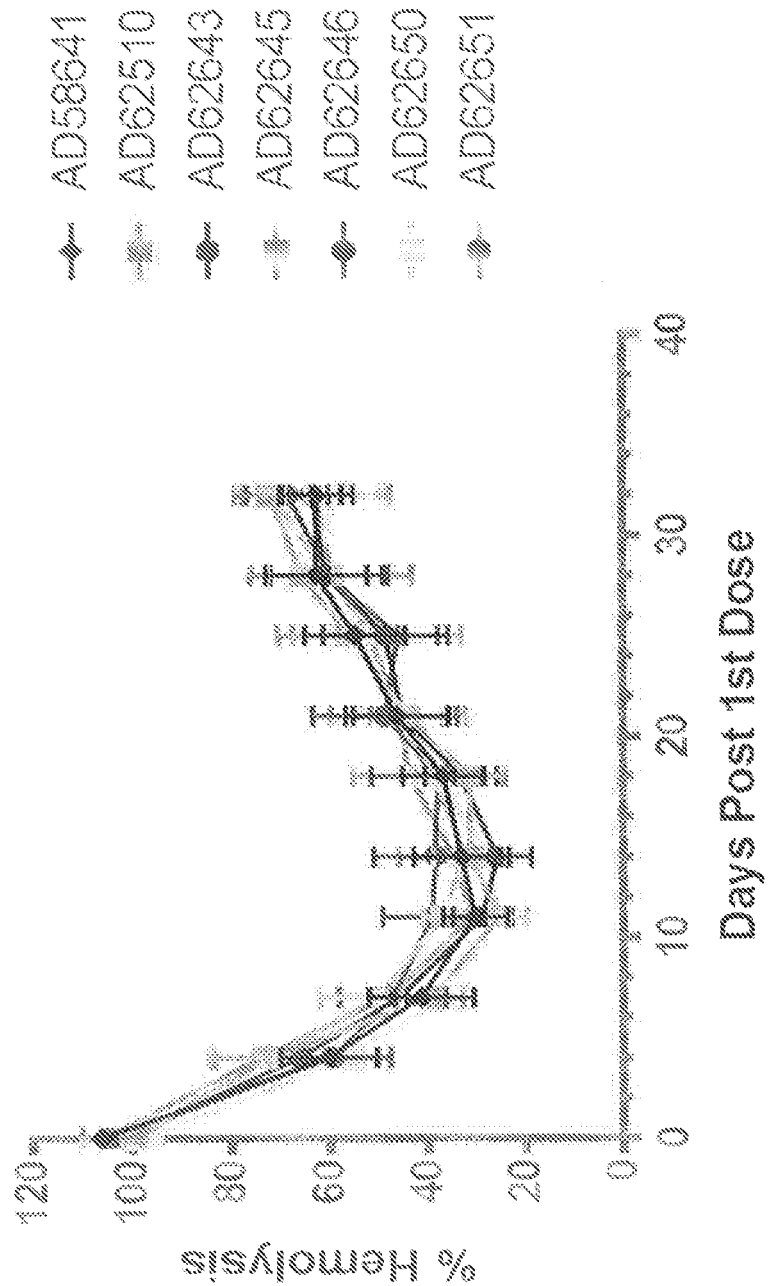
FIG. 17 is a graph showing the percentage of hemolysis remaining in rat serum at various time points following administration of a 5 mg/kg dose of the indicated compounds at days 0, 4, and 7.

The results depicted in FIG. 17 demonstrate that all of the tested iRNAs have a potent and durable decrease in hemolytic activity and a similar recovery of hemolysis to that observed with AD-58641 treatment.

TABLE 23

Modified Sense and Antisense Strand Sequences of GalNAc-Conjugated C5 dsRNAs.

| Duplex ID | sense ID | Sense (5' to 3') | SEQ ID NO: | AS ID | Antisense (5' to 3') | SEQ ID NO: |
|---|---|---|---|---|---|---|
| AD-58643 | A-119326.1 | AfsasGfcAfaGfaUfAfU fuUfuUfaUfaAfuAfL96 | 2873 | A-119327.1 | usAfsuUfaUfaAfaAfauaUfcUfuGfcUfususu | 2886 |
| AD-62642 | A-125167.7 | asasGfcAfaGfaUfAfU fuUfuuAfuAfauaL96 | 2874 | A-125139.1 | usAfsuuaUfaAfaAfauaUfcUfuGfcuususudTdT | 2887 |
| AD-62510 | A-125167.7 | asasGfcAfaGfaUfAfU fuUfuuAfuAfauaL96 | 2875 | A-125173.2 | usAfsUfuAfuAfAfaAfauaUfcUfuGfcuususudTdT | 2888 |
| AD-62643 | A-125167.7 | asasGfcAfaGfaUfAfU fuUfuuAfuAfauaL96 | 2876 | A-125647.1 | usAfsUfuAfuaAfaAfauaUfcUfuGfcuususudTdT | 2889 |
| AD-62644 | A-125157.17 | asasGfcAfaGfaUfA fUfuUfuuAfuaAfuaL96 | 2877 | A-125139.1 | usAfsuuaUfaAfaAfauaUfcUfuGfcuususudTdT | 2890 |
| AD-62645 | A-125157.17 | asasGfcAfaGfaUfA fUfuUfuuAfuaAfuaL96 | 2878 | A-125173.2 | usAfsUfuAfuAfAfaAfauaUfcUfuGfcuususudTdT | 2891 |
| AD-62646 | A-125157.17 | asasGfcAfaGfaUfA fUfuUfuuAfuaAfuaL96 | 2879 | A-125647.1 | usAfsUfuAfuaAfaAfauaUfcUfuGfcuususudTdT | 2892 |
| AD-62647 | A-125134.1 | asasgcaagauaUfuuuua (Tgn)aauaL96 | 2880 | A-125139.1 | usAfsuuaUfaAfaAfauaUfcUfuGfcuususudTdT | 2893 |
| AD-62648 | A-125134.1 | asasgcaagauaUfuuuua (Tgn)aauaL96 | 2881 | A-125173.2 | usAfsUfuAfuAfAfaAfauaUfcUfuGfcuususudTdT | 2894 |
| AD-62649 | A-125134.1 | asasgcaagauaUfuuuua (Tgn)aauaL96 | 2882 | A-125647.1 | usAfsUfuAfuaAfaAfauaUfcUfuGfcuususudTdT | 2895 |
| AD-62428 | A-125127.2 | asasgcaagaUfaU fuuuuauaauaL96 | 2883 | A-125139.1 | usAfsuuaUfaAfaAfauaUfcUfuGfcuususudTdT | 2896 |
| AD-62650 | A-125127.2 | asasgcaagaUfaU fuuuuauaauaL96 | 2884 | A-125173.2 | usAfsUfuAfuAfAfaAfauaUfcUfuGfcuususudTdT | 2897 |
| AD-62651 | A-125127.2 | asasgcaagaUfaU fuuuuauaauaL96 | 2885 | A-125647.1 | usAfsUfuAfuaAfaAfauaUfcUfuGfcuususudTdT | 2898 |

SEQUENCE LISTING (2899 sequences)

SEQ ID NO: 1 - DNA, 5480 bp, Homo sapiens
tatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaaaaaaaaaaaaaaaaaa

SEQ ID NO: 2 - DNA, 5384 bp, Macaca mulatta
  modified_base (2876)..(2895): a, c, t, g, unknown or other
catgatttcctgctacctccaaccatgggccttttgggaatactttgttttttaatcttcctgggaaaaacttggggacaggagcaaacatatgtcatttcagcaccaaaaatattccgtgttggagcatctgaaaacattgtgattcaagtttatggatacactgaagcatttgatgcaacaatctctattaaaagttatcctgataaaaaatttagttactcctcaggccatgttcatttatcctcagagaataaattccaaaactcggcagtcttaacaatacaaccaaaacaattacctggaggacaaaaccaagtttcttatgtgtatttggaagttgtatcaaagcatttttcaaaatcaaaaaaaattccaataacctatgacaatggatttctcttcattcatacagacaaacctgtttatactccagaccaatcagtaaaggttagagtttattcgttgaatgatgacttgaagccagccaaaagagaaactgtcttaactttcatagatcctgaaggatcagaaattgacatggtagaagaaattgatcatattggaattatctcttttcctgacttcaagattccgtctaatcctagatatggtatgtggatgatccaggctaaatataaagaggacttttcaacaactggaactgcattttttgaagttaaagaatatgtcttgccacatttttctgtctcagtagaaccagaaagtaatttcattggttataagaactttaagaattttgaaattactataaaagcaagatatttttataataaagtagtcactgaggctgatgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatattccatcaaggtgcaggttaaagatgcgcttgaccagttggtaggaggggtcccagtaacactgaatgcacaaacaattgatgtcaaccaagagacatctgacttggagccaaggaaaagtgtaacacgtgttgatgatggagtagcttcgtttgtggttaatctcccatctggagtgacggtgctggagtttaatgtcaaaactgatgctccagatcttccagacgaaaatcaggccagggaaggttaccgagcaatagcatactcatctctcagccaaagttacctttatatcgattggactgataaccacaaggctttgctagtgggagaatatttgaatattattgttacccccaaaagcccatatattgacaaaataactcactataattacttgattttatccaagggcaaaattatccactttggcacaagggagaaactttcagatgcatcttatcaaagtataaacattccagtaacgcagaacatggttccttcatcccgactcctggtctattacatcgtcacaggagagcagacagcagaattagtgtctgattcagtctggttaaatattgaagaaaaatgtggcaaccagctccaggttcatctgtctcctgatgcagatacatattctccaggccaaactgtgtctcttaatatggtaactgggatggattcctgggtggcattaacagcagtggacagcgctgtgtatggagtccaaagaagagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattatcaggccaagaagaatgctacaagagaagatagaagaaatagctgctaaatataaacatttagtagtgaagaaatgttgttacgatggagtccgtattaatcatgatgaaacctgtgagcagcgagctgcacggattagtgtagggccgagatgcgtcaaagctttcactgaatgttgtgtcgtcgcaagccagctccgtgctaataactctcataaagacttgcaattgggaaggctacacatgaagaccctgttaccagtaagcaagccagaaattcggagttattttccagaaagctggttatgggaagttcatcttgttcccagaagaaaacagttgcagtttgccctacctgattctgtaactacctgggaaattcaaggtgttggcatttcaaacagtggtatatgtgttgctgatactattaaggcaaaggtgttcaaagatgtcttcctggaaatgaatataccatattctgttgtacgaggagaacaggtccagttgaaaggaactgtttacaactataggacttctgggatgcagttctgtgttaaaatgtctgctgtggagggaatctgcacttcagaaagcccagtcattgatcatcagggcacaaagtcctccaaatgtgtgcgacagaaagtagagggctcctctaatcacttggtgacctttactgtgcttcctctggaaattggccttcagaacatcaatttctcactggagacttcgtttggaaaagaaatcttagtaaaatcgttacgagtggtgccagaaggtgtcaaaagggaaagctattctggtattactttggatcctaggggtatttatgnnnnnnnnnnnnnnnnnnnncgaaaggagttcccatacaggataccattagatttggtccccaaaacagaaatcaaaaggattttgagtgtaaaaggactgcttgtaggtgagatcttgtctgcagttctaagtcgggaaggcatcaatatcctaacccacctccccaaagggagtgcagaggcggagctgatgagcgttgtcccagtattctatgtttttcactacctggaaacaggaaatcattggaacatttttcattccgacccattaattgaaaagcggaacctggagaaaaaattaaaagaagggatggtgagcattatgtcctacagaaatgctgactattcttacagcgtgtggaagggtggcagtgctagcacttggttaacagcttttgctttaagagtacttggacaagtacataaatatgtagagcagaaccaaaattcaatatgtaattctttattgtggctggttgagaattatcagttagataatggatccttcaaggaaaattcacagtatcaaccaataaaattacagaaaatcaacacagctctaattaaagctgacacctttctgcttgaaaatacactgccagcccagagcacctttacattggccatttctgcctatgctctttccctgggagataaaactcacccacagttttgttcaattgtttcagctttgaagagagaagctttggttaaaggtaatccacccatttatcgtttttggaaagacagtcttcaacataaagacagctctgtacctaacactggtacagcacgtatggtagaaacaactgcctatgctttactcaccagtctgaacttgaaagacataaattatgttaacccaatcatcaaatggctatcagaagagcagaggtatggaggtggcttttattcaacccaggacacaatcaatgccatcgagggcctgacagaatattcactcctggttaaacagctccgcttgaatatggacatcgatgttgcttacaagcataaaggtcccttacataattataaaatgacagacaagaatttccttgggaggccagtagaggtgcttctcaatgatgacctcgttgtcagtacaggatttggcagtggcttggctacggtacatgtaacaactgtagttcacaaaaccagtacctctgaggaagtttgcagcttttatttgaaaattgatactcaggatattgaagcatcccactacagaggctacggaaactctgattacaaacgcatagtagcatgtgccagctacaagcccagcaaggaagaatcatcttctggatcctctcatgcagtgatggacatctccttgcctactggaatcaatgcaaatgaagaagacttaaaagctcttgtggaaggggtggatcagctattcactgattaccaaataaaagatggacatgttattctgcaactgaattcgatcccctccagtgatttcctttgtgtacgattccggatttttgaactctttgaagttgggtttcttagtcctgccactttcacagtgtatgaataccacagaccagataaacagtgtaccatgttttatagcacttccaatatcaaaattcagaaagtctgtgaaggagccacgtgcaagtgtatagaagctgattgtgggcaaatgcagaaagaattggatctgacaatctctgcagagactagaaaacaaacagcatgtaacccagagattgcatatgcttataaagttatcatcacatccatcactacagaaaatgtttttgtcaagtacaaggcaacccttctggatatctacaaaactggggaagctgttgctgaaaaagactctgaaatcaccttcattaaaaaggtaacctgcactaacgctgagctggtgaaaggaagacagtacttaattatggggaaagaagctctccagataaaatacaatttcactttcaggtacatctaccctttagattccttgacctggattgaatactggcctagagacacaacatgttcatcgtgtcaagcatttttagctaatttagatgaatttgctgaagacatctttttaaatggatgctaaaattcctgaagttcagctgcatacagtttgcacttatggactcctgttgttgaagtttgtttttttttctcgtttttttgtctttaaacattcacagctggtcttatttgtaaagctcactttacttagaattagtggcacttgcttttattagagaatgattttaaacgctgtaactttctgaaataacatggccttggagggcatgaagacagatactcctccaaggttattggacaccggaaacaataaattagaacacctcctcaaacctaccacttaggaatgtttgctggagccgaaagaacagtccattgaaatggagtattacaaaaacatggcctttgcttgaaagaaaataccaggggacaggaaactgatcattaaagcctgagtttgctttcaaactgtgctaaaaa

SEQ ID NO: 3 - DNA, 5448 bp, Mus musculus
tttaaaaggaaagtggttacagggaggccatgcccatgggtttatgccgctaccagccatgggtctttggggaatactttgtcttttaattttcctggacaaaacttggggacaggaacaaacctacgtcatttcagcacccaaaatcctccgggtcggctcgtctgaaaatgtggtaattcaagtccatggctacactgaagcatttgatgcaactctttctctaaaaagctatcctgacaaaaaagtcaccttctcttcaggctatgttaatttgtccccggaaaacaaattccaaaacgcggcactgttgacactacagcccaatcaagttcctagagaagaaagcccagtctctcacgtgtatctggaagttgtgtcaaaacacttttcaaaatcaaagaaaataccaattacctataacaatggaattctcttcatccatacagacaaacctgtttacacgccggaccagtcagtaaagatcagagtctattctctgggtgacgacttgaagccagccaaacgggagactgtcttaactttcatagaccccgaaggatcagaagttgacattgtagaagaaaatgattacaccggaattatctcttttcctgacttcaagattccatctaatcccaagtatggtgtttggacaattaaagctaactataagaaggattttacaacaactggaactgcatactttgaaattaaagaatatgtcttgccacgattctctgtttcaatagaactagaaagaaccttcattggctataaaaactttaagaactttgaaatcactgtgaaagcaagatatttttataataaagtggtacctgatgctgaagtgtatgccttttttggattgagagaggacataaaagatgaggagaagcagatgatgcacaaagccacacaagccgcaaagttggttgacggagttgctcagatctcttttgattctgaaacagcagttaaagagctgtcctacaacagtctagaagacttaaacaacaagtacctttatattgcagtaacagtcacagaatcttcaggtggattttcagaagaggcagaaatccctggagtcaaatatgtcctctctccctacacactgaatttggtcgctactcctcttttcgtgaagcccgggattccattttccatcaaggcacaggttaaagattcactcgagcaggcggtaggaggggtcccagtaactctgatggcacaaacagtcgatgtgaatcaagagacatctgacttggaaacaaagaggagcatcactcatgacactgatggagtagctgtgtttgtgctgaacctcccatcaaatgtgacggtgctaaagtttgagatcagaactgatgacccagaacttcccgaagaaaatcaagccagcaaagagtacgaagcagttgcgtactcgtctctcagccaaagttacatttacatcgcttggactgaaaactacaagcccatgcttgtgggagaatacctgaatattatggttacccccaagagcccatatatcgacaaaataactcactataattacttgattttatccaaaggcaaaattgtacagtacggcacaagagagaaacttttctcctcaacttatcaaaatataaatattccagtgacacagaacatggttccttcagcacgactcctggtctattacatagtcacaggggagcaaacagcagaattagtggctgacgcagtctggataaatattgaggagaagtgtggcaaccagctccaggtccatctgtctccagatgaatatgtgtattctccaggccaaactgtgtcccttgacatggtgactgaagcagactcatgggtagcactatcagcagtggacagagctgtgtataaagtccagggaaacgccaaaagggccatgcaaagagtctttcaagctttggatgaaaagagtgacctgggctgtggggcaggtggtggccatgacaatgcagatgtattccatctagctgggctcaccttcctcaccaacgcaaacgcagatgactcccattatcgtgatgactcttgtaaagaaattctcaggtcaaagagaaacctgcatctcctaaggcagaaaatagaagaacaagctgctaagtacaaacatagtgtgccaaagaaatgctgctatgacggagcccgagtgaacttctacgaaacctgtgaggagcgagtggcccgggttaccataggccctctctgcatcagggccttcaacgagtgctgtactattgcgaacaagatccgaaaagaaagcccccataaacctgtccaactgggaaggatccacattaagaccctgttaccagtgatgaaggcagatatccgaagctactttccagagagctggctatgggaaattcatcgcgttcccaaaagaaaacagctgcaggtcacgctgcctgactcactaacgacttgggaaattcaaggcattggcatttcagacaatggtatatgtgttgctgatacactcaaggcaaaggtgttcaaagaagtcttcctggagatgaacataccatattctgttgtgcgaggagaacagatccaattgaaaggaactgtttacaactatatgacctcagggacaaagttctgtgttaaaatgtctgctgtggaggggatctgcacttcaggaagctcagctgctagccttcacacctccaggccctccagatgtgtgttccagaggatagagggctcgtccagtcacttggtgaccttcaccctgcttcctctggaaattggccttcactccataaacttctcactagagacctcatttgggaaagacatcttagtaaagacattacgggtagtgccagaaggagtcaagagggaaagctatgccggcgtgattctggaccctaagggaattcgtggtattgttaacagacgaaaggaattcccatacaggatcccattagatttggtccccaagaccaaagttgaaaggattttgagtgtcaaaggactgcttgtaggggagttcttgtccacggttctgagtaaggaaggcatcaacatcctaacccacctccccaagggcagtgcagaggcagagctcatgagcatagctccggtgttctatgttttccactacctggaagcaggaaaccattggaatattttctatcctgatacactgagtaaaagacagagcctggagaaaaaaataaaacaaggggtggtgagcgtcatgtcctacagaaacgctgactattcctacagcatgtggaagggggcgagcgctagtacctggctgacagcttttgctctgagagtgcttggacaggtggccaagtatgtaaaacaggatgaaaactcaatttgtaactctttgctatggctggttgagaagtgtcagctggaaaacggctctttcaaggaaaattcccaatatctaccaataaaattacagggtactttgcctgctgaagcccaagagaaaactttgtatcttacagccttttctgtgattggaattagaaaggcagttgacatatgccccaccatgaaaatccacacagcgctagataaagccgactccttcctgcttgaaaacaccctgccatccaagagcaccttcacactggccattgtagcctatgctctttccctaggagacagaacccacccgaggtttcgtctaattgtgtcggccctgaggaaggaagcttttgttaaaggtgatccgcccatttaccgttactggagagataccctcaaacgtccagacagctctgtgcccagcagcggcacagcaggtatggttgaaaccacagcctatgctttgctcgccagcctgaaactgaaggatatgaattacgccaaccccatcatcaagtggctatctgaagagcagaggtatggaggcggcttttattccacccaggatacgattaatgccatcgagggcctgacagaatattcactcctgttaaaacaaattcatttggatatggacatcaatgtcgcctacaaacacgaaggtgacttccacaagtataaggtgacagagaagcatttcctggggaggccagtggaggtatctctcaatgatgaccttgttgtcagcacaggctacagcagtggcttggccacagtatatgtaaaaactgtggttcacaaaattagtgtctctgaggaattttgcagcttttacttgaaaattgatacccaagatattgaagcatccagccacttcaggctcagtgactctggattcaagcgcataatagcatgtgccagctacaagcccagcaaggaggagtcaacatccgggtcctcccatgcagtaatggatatatcactgccgactggaatcggagcaaacgaggaagatttacgggctcttgtggaaggagtggatcaactactaactgattaccagatcaaagatggccatgtcattctgcaactgaattcgatcccctccagagatttcctctgtgtccggttccggatatttgaacttttccaagttgggtttctgaatcctgctaccttcacggtgtacgagtatcacagaccagataagcagtgcaccatgatttatagcatttctgacaccaggcttcagaaagtctgtgaaggagcagcttgcacatgtgtggaagctgactgtgcgcaactgcaggcagaagtagacctagccatctctgcagactccagaaaagagaaagcctgtaaaccagagactgcatatgcttataaagtcaggatcacatcagccactgaagaaaatgtttttgtcaagtacactgcgactcttctggtcacttacaaaacaggggaagctgctgatgagaattcggaggtcaccttcattaaaaagatgagctgtaccaatgccaacctggtgaaagggaagcagtatttaatcatgggcaaagaggttctgcagatcaaacacaatttcagtttcaagtatatataccctctagattcctccacctggattgaatattggcccacagacacaacgtgtccatcctgtcaagcatttgtagagaatttgaataactttgctgaagacctctttttaaacagctgtgaatgaaaagttctgctgcacgaagattcctcctgcggcggggggattgctcctcctctggcttggaaacctagcctagaatcagatacactttctttagagtaaagcacaagctgatgagttacgactttgtgaaatggatagccttgaggggaggcgaaaacaggtcccccaaggctatcagatgtcagtgccaatagactgaaacaagtctgtaaagttagcagtcaggggtgttggttggggccggaagaagagacccactgaaactgtagccccttatcaaaacatatccttgcttgaaagaaaaataccaaggacagaaaatgccataaaatcttgactttgcactc

SEQ ID NO: 4 - DNA, 4497 bp, Rattus norvegicus
atggatagcacagagaccgacagatgtcctacagcccgccatcatctttccggaaacattaactcagtgcttgctgcccttgtaggtgggttttcggaagaggcagaaattcctggcatcaaatacgtcctctctccctatacactgaatttggtcgctacccctcttttcctgaagcctgggattccattttccatcaaggtacaggttaaggattcactcgagcagttggtaggaggggtcccagtaactctgatggcacaaacagtcaatgtgaatcaagagacatctgacttggaaccaaagaggagcatcacacactctgctgatggagtggcttcatttgtggtgaacctcccatcagaagtgacatcactgaagtttgaggtcaaaactgatgccccggaacttcccgaagaaaatcaagccagcaaagaatatgaagcagttacatactcatccctcagccagagttacatttacattggctggactgaaaactacaagcccatgcttgtgggagaatatctgaatattatcgtcacccccaagagtccatatattgacaaaataactcactataattacttgattttatccaaaggcaaaattgtacagtatggcacaaaggagaaacttctctattcatcttatcaaaatataaacatcccagtgacacaggacatggttccttcagcgcggctcctggtctattacatagtcacgggggagcagacagcagaattggtggctgacgcagtctggataaacattgaggagaagtgtggcaaccagctccaggtccatctgtctccagataaagacgtgtattctccaggccaaactgtgtcccttgacatggtgactgaagcagactcatgggtggcactatctgcggtggacagcgctgtgtatggagtccggggaaaagccaaaagggccatgcaaagagtgttccaagcttttgatgacaagagtgacctgggctgtggggcaggtggtggccgtgacaatgtagatgtattccatctagctgggctcaccttcctcaccaatgcaaacgcagatgactcccaataccacgatgactcttgtaaggaaattctcaggccaaagagagacctgcagctcctgcatcagaaagtggaagaacaagctgctaaatacaaacaccgtgtgcccaagaaatgctgttatgatggagcccgagaaaacaaatacgaaacctgtgagcagcgagttgcccgggtgaccataggcccacactgcatcagggccttcaacgagtgttgtactattgcggataagatccgaaaagaaagccaccacaaaggcatgctgttgggaaggatccaaataaaggccctgttaccagtgatgaaggcagaaatccgaagctactttccagagagctggctatgggaagttcatcgtgttcccaaaagaaaccagctgcaggttgcactgcctgactcactgacgacctgggaaattcaaggcatcggcatctcagacaatggtatatgtgttgctgacacactcaaggcaaaggtgttcaaagatgtcttcctggagatgaacataccatattctgttgtacgaggggagcagatccaattgaagggaaccgtttacaattataggacctctgggacaatgttctgtgttaaaatgtctgccgtggagggaatctgcactccaggaagctcggctgctagccctcagacctctaggtcctccagatgtgtgcgccagagaatagagggctcctccagtcacttggtgaccttcagcctgcttcctctggaaattggccttcactccataaacttctcactagagacttcatttgggaaagaaatcttagtgaagacattacgggtagtgccagaagggatcaaaagggaaagctatgctggtgtgactctggaccccaggggagtttatggtattgttaacagacgaaaggaattcccatacaggataccattagatttggtccccaaaaccaacgtcaaaaggattttgagtgtaaaaggactgcttataggggaattcttgtccacggttctgagtaaagaaggcatcgacatcctaacccacctccccaagggcagcgccgaggcagaactcatgagcatagtcccggtgttctacgttttccactacctggaagcaggaaaccattggaatattttccaccctgatacgttagctagaaaacagagcctgcagaaaaaaataaaagaagggctggtgagcgtcatgtcctacagaaacgctgactattcctacagcatgtggaagggagcaagctctagtgcctggctgacagcttttgctctgagagtgcttggacaggtgaacaagtatgtgaaacaagaccaatactcgatctgtaactccttgttatggctgattgagaagtgtcagctggaaaacggatctttcaaggaaaattcccaatatctaccaataaaattacagggtactttgcctgctgaagcccaagagaacactttatatcttacagccttttctgtgattggaattagaaaggctattggcatatgccccacggagaaaatctacacagcgctggctaaagctgactccttcctacttgaaaggaccctgccttccaagagcaccttcaccctggccattgtggcctatgctctctccctgggagacagaacccacccgaagtttcgttctattgtgtcagccctgaagagggaagctttggttaaaggagacccgcccatttaccgtttctggagagacactctccaacgtccagacagctcagcacccaacagcggcacagcaggtatggtagaaaccacggcctatgctttgctcaccagcctgaacctgaaggagacgagttatgtcaacccgatcatcaagtggctatctgaggagcagaggtatggaggcggcttttattccacccaggataccattaacgccatcgagggcctgacagagtattcactcctggttaaacaacttcatttggatatggatatcaatgtctcctacaaacacaaaggggatttctaccagtataaagtgacagagaagaacttcctcgggaggccagtggaggtacccctcaatgatgacctcatcgtcaccacaggctatagcagtggcttggctacagtatatgtaaaaactgtggttcacaaaactagtgtcgctgaggaattttgcagcttttacttgaaaattgatacccaagaagttgaagcctccagctacctcagctacagtgactcgggacacaagcgcataatagcctgtgccagctacaagcccagcaaggaggagtcagcatctgggtcctcccatgcagtaatggatatactgctgccgaccggaatcggagcaaaccaagaagatttacgagctcttgtggaaggagtagatcaactcctaactgattaccagatcaaagacagtcatgttattctgcaattgaattcgattccctccagagatttcctttgtgttcggttccggatatttgaacttttccaagttgggtttctgaatcctgctacgttcacggtgtacgagtatcacagaccagataagcagtgtaccatgatttacagcacttctgacaccaaccttcagagagtctgtgaaggagcggcatgcaaatgcgttgaagctgattgtgggcaactgcaggcagaactggacctggccatctctgcagacaccaggaaagaaacagcatgtaaaccagagattgcatatgcttataaggtcaggatcacgtcggccacggaagaaaacatttttgtcaagtacactgcgacgcttctggatatttacaaaacaggggaagccgctgctgagaaggactctgagatcaccttcattaaaaagataagctgtaccaacgccaacctggtgaaaggaaagcaatatttaatcatgggcaaagaggctctgcagatcaaacacaatttcagtttcaagtatatataccctctagattcctccacctggattgaatattggcccacagacacaacgtgtccatcctgccaagcgtttgtagctaatttggacgagttcgctgaagacatctttctaaatggctgtgaaaatgcctgaggaagttctgctgcgtggccttcccgggtactcctgttggtggctcctaggagccaggatcgcttggaaacttagcctagaatcggatacattttctttatagtaaagcgtaagttgaagagttactttgtgaaacaaaatagccttgtggagagccgaaggcaggtcccccaaggctattggacatcagcaccaataagctggaacaagtctgtaacgttagcagccaggggtgtttgttggggccggaagaagagactcactgaaattgtagccccttaggaaaacatggtcttgcttgaaaaaaaaaataccaaggacagaaaatgccataaaagcttgactttgcactcaactgta

SEQ ID NO: 5 - DNA, 5480 bp, Homo sapiens
ttttttttttttttttttgaaagcaaactcaggctttaatgatcagtttcctgttccttggtattttctttcaagcaaaggccatgtttttgtaatactccctttcaatggactgttctttcggccccagcaaacattcctgagtggtaggtttgaggaggtgttccaatttattgtttccggtgtccaataaccttggaggagtatctgtcttcatgccctccaaggccatgttatttcagaaagttacagcatttgaaatcattctctaataaaagcaagtgccactaattctaagtaaagtgagctttacaaataagaccagctatgaatgtttaaaaaaagaagaaaacaaaaaaacgaacttcaacaacaggagtccataagtgcaaactgtatgcagctgaacttcaggaattttagcatccatttaaaaagatatcttcggcaaattcatctaaattagctaaaaatgcttgacacgatgaacatgttgtgtctctaggccagtattcaatccaggtcaaggaatctaaagggtagatgtacctgaaactgaaattgtattttatctggagggcttctttacccataattaagtactgtcttccttttaccagctcagcgttagtacaggttacctttttaatgaaggtaatctcagagtctttctcagcaacagcttccccagttttgtagatatccagaagggttgccttgtacttgacaaaaacattttctacagtgatggatgtgatgctaactttataagcatatgcaatctctggtttacatgctgtttgttttcttgtctctgcagagattgtcagatccaattcttcctgcatttgcccacaatcagcttctacacacttgcacgcggctccttcacagactttctgaattttgatattggaagtgctataaaacatggtacactgtttatctggtctgtggtattcgtacactgtgaaagtggcaggactgagaaacccaacttcaaagagttcaaatatccggaatcgtacacaaaggaaatcactggagggaatcgaattcagttgcagaataacatgtccatctttgatttggtaatcagtgaatagttgatccaccccttccacaagggcttttaagtcttcttcatttgcactgattccagtaggcaaggagatgtccatcaccgcatgagaggatccagatgatgattcttccctgctgggcttgtagctggcacatgctactatgcgtttgtaatcagagtttccgtagcctctgtagtgggatgcttcaatatcctgagtatcgattttcaaataaaagctgcaaacttcctcagaggtactggttttgtgaactacagttgttacatgtactgtagccaagccactgccaaatcctgtactgacaatgaggtcatcattgagaagcacctctactggcctcccaaggaaattcttgtctgtcattttataattatgtaaggcacctttatgcttgtaagaaacatcgatgtccatactcaagcggagttgtttaaccaggagtgaatattccgtcaggccctcaatggcattgattgtgtcctgggttgaataaaagccacctccatacctctgctcttctgatagccatttgatgactgggttaacataatttatatctttcaagttcagactggtgagtaaagcataggcagttgtttctaccatacgtgccgtaccagtgttaggtacagagctgtctttatgctgaagattgtctttccaaaaacgataaatgggtggattacctttaaccaaagcttctctcttcaaagctgaaacaattgaacgaaactgtgggtgagttttatctcccagggaaagagcatacgcagaaatggccaatgtaaaggtgctctgggctggcagtgtattttcaagcagaaagttgtcagctttaattagagctgtgtcgattttcaccagggggcatatatcgaaagcctttctaattccaatcacagtaaaggctgtaagatataagctgttctctcgggcttcaacaggcaaggtaccctgtaattttattggttgatactgtgaattttccttgaaagatccattatctaattgataattctcaactagccacaataaagaattacaaattgaattttggttctgctctacgtatttatttacttgtccaagtactcttaaagcaaaagctgttaaccaagtgctagcacttccacccttccacacactgtaagagtagtcagcatttctgtaggacataatgctcaacatcccttcttttaattttttcttcagtttctgcttttcaattaatgggtcagaatgaaaaatgttccaatgatttcctgtttccaggtagtgaaaaacatagaatactgggacaacgctcatcagctccgcctctgcactccctttggggaggtgggttaggatattgatgccttcctgacttagaactgcagacaagatctcacctacaagcagtccttttacactcaaaatccttttgatttctgttttggggaccaaatctaagggtatcctgtatgggaactcctttcgtctgctaatggtaccataaatacccctaggatccaaagtaacaccagaatagctttcccttttgacaccttctggcaccactcgtaatgtttttactaagatttcttttccaaaccaagtctccagtgaaaaattgatgttgtgaaggccaatttccagaggaagcacagtgaatgtcaccaagtgactggaggagccctctactttctggcgcacacatttggaggactttgtgccctgatgatcaatgactgggctttccgaagtgcagattccctccacagcagacattttaacacagaactgcatcccagaagtcctatagttgtaaacagttcctttcaattggatctgttctcctcgtacaacagaatatggtatattcatttccaggaagacatctttgaacacctttgccttgacagtatcagcaacacatataccagtgtttgaaatgccaacgccttgaatttcccaggtggttagagaatcaggtagggcaaactgcaactgttttcttctgggaacaagatgaacttcccacaaccagctttctggaaaataactccgaatttctggcttgcttactggtaacagggtcttcatgtgtagccttcccaattgcatgtctttatgagagatattagcacggagctggcttgcgacgacacaacattcagtgaaagctttgatgcatcttggccctaaactaatccgtgcagctcgctgctcacaggtttcatcattattaacgcaggctccatcgtaacaacatttcttcactactgaatgtttatatttagcagctatttcttctatcttcttttgcagcgttcttcttggcctgagaatttctttacaaggttcatcattttcttgggagtcatctgcatttgcattagtgaggaaggtaagtccagctaggtggaacacattggcattgttgaggccaccacctgccccacagcccagatcactcttctctaagaattgaaatactctttccaagggctttttggctcctctttggactccatacacagcactgtccactgctgctaatgccacccaggaatccattccagttgccatattaagagacacagtttggcctggagaatatgcatctgcatcaggagacagatgaacctggagctggttgccacatttttcttcaatatttaaccagactgaatcagacactaattctgctgtctgttctcctgtgacgatgtaatagaccagaagtcgggatgaaggaaccatgttctgtgttactggaatgtttatactttgataagatgcatctgaaaatttctccctcgtgccaaagtggataattttgcccttggataaaatcaagtaattatagtgagttattttgtcaatatatgggcttttgggggtaacaataatattcagatgttctcccactagcaaagccttatggttatcagtccaatcaatataaaggtaactttggctgagagatgagtatgctattgctcggtaaccttccctggcctgattttcttctggaagatctggagcatcagttttgacattaaactccagcaccgtcactccagatgggagattaagcacaaaggaagctactccatcatcaacacgtgttacacttttgcttggatccaagtcagatgtctcttggtttacatcaattgtttgtgcattcagtgttactgggactcctcctaccaactggtcaagcgaatctttaacctgcaccttgatgggatatggaatcccaggcttcaggaaaagaggagtagcaaccaaattcagtttgtagggagagaggacatatttgatgccaggtatttctgcctcttcagaaaatccacctgtagactctatgactgttacagcaatataaaggtacttgttgtttaaatcttctaaactgtagtatgacagttctttgactgctgtttcagaatcaaatgtgacttgagcaattccatttatcaacattgtgttttgcattgctgtttgcatcatttctttttgatcatcttttaagtcttctcttattccaaatgtgatataaacgtcagcctcagtgactactttattataaaaatatcttgcttttatagtaatttcaaaattcttaaagttcttgtaaccaatgaaattatattctggctcgattgagacagaaaaatgtggcaagacatattctttaacttcaaaatatgcggttccagttgttgaaaagtcctctttatatttagccttgatcgtccacataccatatctaggattagacggaatcttgaagtcaggaaaagagataattccaatatgatcaatttcttctaccatgtcaacttctgatccttcaggatctatgaaagttaagacagtttctcttttggctggcttcaagtcgtcattcaacgaataaactctaacttttactgactggtctggagtataaacaggtttgtctgtatgaatgaagagaaatccattgtcataggttattggcattctttttgattttgaaaaatgctttgatacaacttccaaatacacataagaaactgggttttgtcctccaggcaattgttttggttgtattgttaagattgcagagttttggaatttattctctgaggataaatgaacatggcctgaggagtaactaaattttttatcaggataacttttaatagagattgttgcatcaaatgcttcagtgtatccataaacttgaatcacaatattttcagatgctccaacacggaatatttttggtgctgaaatgacatatgtttgctcctgtccccaggttttccccaggaagattaaaaaacaaagtattcccaaaaggcccatggttggaggtagcaggaaaccacggatata

SEQ ID NO: 6 - DNA, 5384 bp, Macaca mulatta
  modified_base (2490)..(2509): a, c, t, g, unknown or other
tttttagcacagtttgaaagcaaactcaggctttaatgatcagtttcctgtcccctggtattttctttcaagcaaaggccatgtttttgtaatactccatttcaatggactgttctttcggctccagcaaacattcctaagtggtaggtttgaggaggtgttctaatttattgtttccggtgtccaataaccttggaggagtatctgtcttcatgccctccaaggccatgttatttcagaaagttacagcgtttaaaatcattctctaataaaagcaagtgccactaattctaagtaaagtgagctttacaaataagaccagctgtgaatgtttaaagacaaaaaaacgagaaaaaaaaacaaacttcaacaacaggagtccataagtgcaaactgtatgcagctgaacttcaggaattttagcatccatttaaaaagatgtcttcagcaaattcatctaaattagctaaaaatgcttgacacgatgaacatgttgtgtctctaggccagtattcaatccaggtcaaggaatctaaagggtagatgtacctgaaagtgaaattgtattttatctggagagcttctttccccataattaagtactgtcttcctttcaccagctcagcgttagtgcaggttacctttttaatgaaggtgatttcagagtctttttcagcaacagcttccccagttttgtagatatccagaagggttgccttgtacttgacaaaaacattttctgtagtgatggatgtgatgataactttataagcatatgcaatctctgggttacatgctgtttgttttctagtctctgcagagattgtcagatccaattctttctgcatttgcccacaatcagcttctatacacttgcacgtggctccttcacagactttctgaattttgatattggaagtgctataaaacatggtacactgtttatctggtctgtggtattcatacactgtgaaagtggcaggactaagaaacccaacttcaaagagttcaaaaatccggaatcgtacacaaaggaaatcactggaggggatcgaattcagttgcagaataacatgtccatcttttatttggtaatcagtgaatagctgatccaccccttccacaagagcttttaagtcttcttcatttgcattgattccagtaggcaaggagatgtccatcactgcatgagaggatccagaagatgattcttccttgctgggcttgtagctggcacatgctactatgcgtttgtaatcagagtttccgtagcctctgtagtgggatgcttcaatatcctgagtatcaattttcaaataaaagctgcaaacttcctcagaggtactggttttgtgaactacagttgttacatgtaccgtagccaagccactgccaaatcctgtactgacaacgaggtcatcattgagaagcacctctactggcctcccaaggaaattcttgtctgtcattttataattatgtaagggacctttatgcttgtaagcaacatcgatgtccatattcaagcggagctgtttaaccaggagtgaatattctgtcaggccctcgatggcattgattgtgtcctgggttgaataaaagccacctccatacctctgctcttctgatagccatttgatgattgggttaacataatttatgtctttcaagttcagactggtgagtaaagcataggcagttgtttctaccatacgtgctgtaccagtgttaggtacagagctgtctttatgttgaagactgtctttccaaaaacgataaatgggtggattacctttaaccaaagcttctctcttcaaagctgaaacaattgaacaaaactgtgggtgagttttatctcccagggaaagagcataggcagaaatggccaatgtaaaggtgctctgggctggcagtgtattttcaagcagaaaggtgtcagctttaattagagctgtgttgattttctgtaattttattggttgatactgtgaattttccttgaaggatccattatctaactgataattctcaaccagccacaataaagaattacatattgaattttggttctgctctacatatttatgtacttgtccaagtactcttaaagcaaaagctgttaaccaagtgctagcactgccacccttccacacgctgtaagaatagtcagcatttctgtaggacataatgctcaccatcccttcttttaattttttctccaggttccgcttttcaattaatgggtcggaatgaaaaatgttccaatgatttcctgtttccaggtagtgaaaaacatagaatactgggacaacgctcatcagctccgcctctgcactccctttggggaggtgggttaggatattgatgccttcccgacttagaactgcagacaagatctcacctacaagcagtccttttacactcaaaatccttttgatttctgttttggggaccaaatctaatggtatcctgtatgggaactcctttcgnnnnnnnnnnnnnnnnnnnncataaatacccctaggatccaaagtaataccagaatagctttcccttttgacaccttctggcaccactcgtaacgattttactaagatttcttttccaaacgaagtctccagtgagaaattgatgttctgaaggccaatttccagaggaagcacagtaaaggtcaccaagtgattagaggagccctctactttctgtcgcacacatttggaggactttgtgccctgatgatcaatgactgggctttctgaagtgcagattccctccacagcagacattttaacacagaactgcatcccagaagtcctatagttgtaaacagttcctttcaactggacctgttctcctcgtacaacagaatatggtatattcatttccaggaagacatctttgaacacctttgccttaatagtatcagcaacacatataccactgtttgaaatgccaacaccttgaatttcccaggtagttacagaatcaggtagggcaaactgcaactgttttcttctgggaacaagatgaacttcccataaccagctttctggaaaataactccgaatttctggcttgcttactggtaacagggtcttcatgtgtagccttcccaattgcaagtctttatgagagttattagcacggagctggcttgcgacgacacaacattcagtgaaagctttgacgcatctcggccctacactaatccgtgcagctcgctgctcacaggtttcatcatgattaatacggactccatcgtaacaacatttcttcactactaaatgtttatatttagcagctatttcttctatcttctcttgtagcattcttcttggcctgataatttctttacaaggttcatcattttcttgggagtcatctgcatttgcattagtgaggaaggtaagtccagctaggtggaacacattggcattgttgaggccaccacctgccccacagcccagatcactcttctctaagaattgaaatactctttccaagggctttttggctcttctttggactccatacacagcgctgtccactgctgttaatgccacccaggaatccatcccagttaccatattaagagacacagtttggcctggagaatatgtatctgcatcaggagacagatgaacctggagctggttgccacatttttcttcaatatttaaccagactgaatcagacactaattctgctgtctgctctcctgtgacgatgtaatagaccaggagtcgggatgaaggaaccatgttctgcgttactggaatgtttatactttgataagatgcatctgaaagtttctcccttgtgccaaagtggataattttgcccttggataaaatcaagtaattatagtgagttattttgtcaatatatgggcttttgggggtaacaataatattcaaatattctcccactagcaaagccttgtggttatcagtccaatcgatataaaggtaactttggctgagagatgagtatgctattgctcggtaaccttccctggcctgattttcgtctggaagatctggagcatcagttttgacattaaactccagcaccgtcactccagatgggagattaaccacaaacgaagctactccatcatcaacacgtgttacacttttccttggctccaagtcagatgtctcttggttgacatcaattgtttgtgcattcagtgttactgggacccctcctaccaactggtcaagcgcatctttaacctgcaccttgatggaatatggaatcccaggcttcaggaaaagaggagtagcaaccaaattcagtttgtagggagagaggacatatttgatgccaggtatttctgcctcttcagaaaatccacctgtagactctatgactgttacagcaatataaaggtacttgttgtttaaatcttctaaactgtagtatgacagttctttgactgctgtttcagaatcaaatgtgacttgagcaattccatttatcaacattgtgttttgcattgctgtttgcatcatttctttttgatcatcttttaagtcttctcttattccaaatgtgatataaacatcagcctcagtgactactttattataaaaatatcttgcttttatagtaatttcaaaattcttaaagttcttataaccaatgaaattactttctggttctactgagacagaaaaatgtggcaagacatattctttaacttcaaaaaatgcagttccagttgttgaaaagtcctctttatatttagcctggatcatccacataccatatctaggattagacggaatcttgaagtcaggaaaagagataattccaatatgatcaatttcttctaccatgtcaatttctgatccttcaggatctatgaaagttaagacagtttctcttttggctggcttcaagtcatcattcaacgaataaactctaacctttactgattggtctggagtataaacaggtttgtctgtatgaatgaagagaaatccattgtcataggttattggaattttttttgattttgaaaaatgctttgatacaacttccaaatacacataagaaacttggttttgtcctccaggtaattgttttggttgtattgttaagactgccgagttttggaatttattctctgaggataaatgaacatggcctgaggagtaactaaattttttatcaggataacttttaatagagattgttgcatcaaatgcttcagtgtatccataaacttgaatcacaatgttttcagatgctccaacacggaatatttttggtgctgaaatgacatatgtttgctcctgtccccaagtttttcccaggaagattaaaaaacaaagtattcccaaaaggcccatggttggaggtagcaggaaatcatg

SEQ ID NO: 7 - DNA, 5448 bp, Mus musculus
gagtgcaaagtcaagattttatggcattttctgtccttggtatttttctttcaagcaaggatatgttttgataaggggctacagtttcagtgggtctcttcttccggccccaaccaacacccctgactgctaactttacagacttgtttcagtctattggcactgacatctgatagccttgggggacctgttttcgcctcccctcaaggctatccatttcacaaagtcgtaactcatcagcttgtgctttactctaaagaaagtgtatctgattctaggctaggtttccaagccagaggaggagcaatccccccgccgcaggaggaatcttcgtgcagcagaacttttcattcacagctgtttaaaaagaggtcttcagcaaagttattcaaattctctacaaatgcttgacaggatggacacgttgtgtctgtgggccaatattcaatccaggtggaggaatctagagggtatatatacttgaaactgaaattgtgtttgatctgcagaacctctttgcccatgattaaatactgcttccctttcaccaggttggcattggtacagctcatctttttaatgaaggtgacctccgaattctcatcagcagcttcccctgttttgtaagtgaccagaagagtcgcagtgtacttgacaaaaacattttcttcagtggctgatgtgatcctgactttataagcatatgcagtctctggtttacaggctttctcttttctggagtctgcagagatggctaggtctacttctgcctgcagttgcgcacagtcagcttccacacatgtgcaagctgctccttcacagactttctgaagcctggtgtcagaaatgctataaatcatggtgcactgcttatctggtctgtgatactcgtacaccgtgaaggtagcaggattcagaaacccaacttggaaaagttcaaatatccggaaccggacacagaggaaatctctggaggggatcgaattcagttgcagaatgacatggccatctttgatctggtaatcagttagtagttgatccactccttccacaagagcccgtaaatcttcctcgtttgctccgattccagtcggcagtgatatatccattactgcatgggaggacccggatgttgactcctccttgctgggcttgtagctggcacatgctattatgcgcttgaatccagagtcactgagcctgaagtggctggatgcttcaatatcttgggtatcaattttcaagtaaaagctgcaaaattcctcagagacactaattttgtgaaccacagtttttacatatactgtggccaagccactgctgtagcctgtgctgacaacaaggtcatcattgagagatacctccactggcctccccaggaaatgcttctctgtcaccttatacttgtggaagtcaccttcgtgtttgtaggcgacattgatgtccatatccaaatgaatttgttttaacaggagtgaatattctgtcaggccctcgatggcattaatcgtatcctgggtggaataaaagccgcctccatacctctgctcttcagatagccacttgatgatggggttggcgtaattcatatccttcagtttcaggctggcgagcaaagcataggctgtggtttcaaccatacctgctgtgccgctgctgggcacagagctgtctggacgtttgagggtatctctccagtaacggtaaatgggcggatcacctttaacaaaagcttccttcctcagggccgacacaattagacgaaacctcgggtgggttctgtctcctagggaaagagcataggctacaatggccagtgtgaaggtgctcttggatggcagggtgttttcaagcaggaaggagtcggctttatctagcgctgtgtggattttcatggtggggcatatgtcaactgcctttctaattccaatcacagaaaaggctgtaagatacaaagttttctcttgggcttcagcaggcaaagtaccctgtaattttattggtagatattgggaattttccttgaaagagccgttttccagctgacacttctcaaccagccatagcaaagagttacaaattgagttttcatcctgttttacatacttggccacctgtccaagcactctcagagcaaaagctgtcagccaggtactagcgctcgcccccttccacatgctgtaggaatagtcagcgtttctgtaggacatgacgctcaccaccccttgttttatttttttctccaggctctgtcttttactcagtgtatcaggatagaaaatattccaatggtttcctgcttccaggtagtggaaaacatagaacaccggagctatgctcatgagctctgcctctgcactgcccttggggaggtgggttaggatgttgatgccttccttactcagaaccgtggacaagaactcccctacaagcagtcctttgacactcaaaatcctttcaactttggtcttggggaccaaatctaatgggatcctgtatgggaattcctttcgtctgttaacaataccacgaattcccttagggtccagaatcacgccggcatagctttccctcttgactccttctggcactacccgtaatgtctttactaagatgtctttcccaaatgaggtctctagtgagaagtttatggagtgaaggccaatttccagaggaagcagggtgaaggtcaccaagtgactggacgagccctctatcctctggaacacacatctggagggcctggaggtgtgaaggctagcagctgagcttcctgaagtgcagatcccctccacagcagacattttaacacagaactttgtccctgaggtcatatagttgtaaacagttcctttcaattggatctgttctcctcgcacaacagaatatggtatgttcatctccaggaagacttctttgaacacctttgccttgagtgtatcagcaacacatataccattgtctgaaatgccaatgccttgaatttcccaagtcgttagtgagtcaggcagcgtgacctgcagctgttttcttttgggaacgcgatgaatttcccatagccagctctctggaaagtagcttcggatatctgccttcatcactggtaacagggtcttaatgtggatccttcccagttggacaggtttatgggggctttcttttcggatcttgttcgcaatagtacagcactcgttgaaggccctgatgcagagagggcctatggtaacccgggccactcgctcctcacaggtttcgtagaagttcactcgggctccgtcatagcagcatttctttggcacactatgtttgtacttagcagcttgttcttctattttctgccttaggagatgcaggtttctctttgacctgagaatttctttacaagagtcatcacgataatgggagtcatctgcgtttgcgttggtgaggaaggtgagcccagctagatggaatacatctgcattgtcatggccaccacctgccccacagcccaggtcactcttttcatccaaagcttgaaagactctttgcatggcccttttggcgtttccctggactttatacacagctctgtccactgctgatagtgctacccatgagtctgcttcagtcaccatgtcaagggacacagtttggcctggagaatacacatattcatctggagacagatggacctggagctggttgccacacttctcctcaatatttatccagactgcgtcagccactaattctgctgtttgctcccctgtgactatgtaatagaccaggagtcgtgctgaaggaaccatgttctgtgtcactggaatatttatattttgataagttgaggagaaaagtttctctcttgtgccgtactgtacaattttgcctttggataaaatcaagtaattatagtgagttattttgtcgatatatgggctcttgggggtaaccataatattcaggtattctcccacaagcatgggcttgtagttttcagtccaagcgatgtaaatgtaactttggctgagagacgagtacgcaactgcttcgtactctttgctggcttgattttcttcgggaagttctgggtcatcagttctgatctcaaactttagcaccgtcacatttgatgggaggttcagcacaaacacagctactccatcagtgtcatgagtgatgctcctctttgtttccaagtcagatgtctcttgattcacatcgactgtttgtgccatcagagttactgggacccctcctaccgcctgctcgagtgaatctttaacctgtgccttgatggaaaatggaatcccgggcttcacgaaaagaggagtagcgaccaaattcagtgtgtagggagagaggacatatttgactccagggatttctgcctcttctgaaaatccacctgaagattctgtgactgttactgcaatataaaggtacttgttgtttaagtcttctagactgttgtaggacagctctttaactgctgtttcagaatcaaaagagatctgagcaactccgtcaaccaactttgcggcttgtgtggctttgtgcatcatctgcttctcctcatcttttatgtcctctctcaatccaaaaaaggcatacacttcagcatcaggtaccactttattataaaaatatcttgctttcacagtgatttcaaagttcttaaagtttttatagccaatgaaggttctttctagttctattgaaacagagaatcgtggcaagacatattctttaatttcaaagtatgcagttccagttgttgtaaaatccttcttatagttagctttaattgtccaaacaccatacttgggattagatggaatcttgaagtcaggaaaagagataattccggtgtaatcattttcttctacaatgtcaacttctgatccttcggggtctatgaaagttaagacagtctcccgtttggctggcttcaagtcgtcacccagagaatagactctgatctttactgactggtccggcgtgtaaacaggtttgtctgtatggatgaagagaattccattgttataggtaattggtattttctttgattttgaaaagtgttttgacacaacttccagatacacgtgagagactgggctttcttctctaggaacttgattgggctgtagtgtcaacagtgccgcgttttggaatttgttttccggggacaaattaacatagcctgaagagaaggtgacttttttgtcaggatagctttttagagaaagagttgcatcaaatgcttcagtgtagccatggacttgaattaccacattttcagacgagccgacccggaggattttgggtgctgaaatgacgtaggtttgttcctgtccccaagttttgtccaggaaaattaaaagacaaagtattccccaaagacccatggctggtagcggcataaacccatgggcatggcctccctgtaaccactttccttttaaa

SEQ ID NO: 8 - DNA, 4497 bp, Rattus norvegicus
tacagttgagtgcaaagtcaagcttttatggcattttctgtccttggtattttttttttcaagcaagaccatgttttcctaaggggctacaatttcagtgagtctcttcttccggccccaacaaacacccctggctgctaacgttacagacttgttccagcttattggtgctgatgtccaatagccttgggggacctgccttcggctctccacaaggctattttgtttcacaaagtaactcttcaacttacgctttactataaagaaaatgtatccgattctaggctaagtttccaagcgatcctggctcctaggagccaccaacaggagtacccgggaaggccacgcagcagaacttcctcaggcattttcacagccatttagaaagatgtcttcagcgaactcgtccaaattagctacaaacgcttggcaggatggacacgttgtgtctgtgggccaatattcaatccaggtggaggaatctagagggtatatatacttgaaactgaaattgtgtttgatctgcagagcctctttgcccatgattaaatattgctttcctttcaccaggttggcgttggtacagcttatctttttaatgaaggtgatctcagagtccttctcagcagcggcttcccctgttttgtaaatatccagaagcgtcgcagtgtacttgacaaaaatgttttcttccgtggccgacgtgatcctgaccttataagcatatgcaatctctggtttacatgctgtttctttcctggtgtctgcagagatggccaggtccagttctgcctgcagttgcccacaatcagcttcaacgcatttgcatgccgctccttcacagactctctgaaggttggtgtcagaagtgctgtaaatcatggtacactgcttatctggtctgtgatactcgtacaccgtgaacgtagcaggattcagaaacccaacttggaaaagttcaaatatccggaaccgaacacaaaggaaatctctggagggaatcgaattcaattgcagaataacatgactgtctttgatctggtaatcagttaggagttgatctactccttccacaagagctcgtaaatcttcttggtttgctccgattccggtcggcagcagtatatccattactgcatgggaggacccagatgctgactcctccttgctgggcttgtagctggcacaggctattatgcgcttgtgtcccgagtcactgtagctgaggtagctggaggcttcaacttcttgggtatcaattttcaagtaaaagctgcaaaattcctcagcgacactagttttgtgaaccacagtttttacatatactgtagccaagccactgctatagcctgtggtgacgatgaggtcatcattgaggggtacctccactggcctcccgaggaagttcttctctgtcactttatactggtagaaatcccctttgtgtttgtaggagacattgatatccatatccaaatgaagttgtttaaccaggagtgaatactctgtcaggccctcgatggcgttaatggtatcctgggtggaataaaagccgcctccatacctctgctcctcagatagccacttgatgatcgggttgacataactcgtctccttcaggttcaggctggtgagcaaagcataggccgtggtttctaccatacctgctgtgccgctgttgggtgctgagctgtctggacgttggagagtgtctctccagaaacggtaaatgggcgggtctcctttaaccaaagcttccctcttcagggctgacacaatagaacgaaacttcgggtgggttctgtctcccagggagagagcataggccacaatggccagggtgaaggtgctcttggaaggcagggtcctttcaagtaggaaggagtcagctttagccagcgctgtgtagattttctccgtggggcatatgccaatagcctttctaattccaatcacagaaaaggctgtaagatataaagtgttctcttgggcttcagcaggcaaagtaccctgtaattttattggtagatattgggaattttccttgaaagatccgttttccagctgacacttctcaatcagccataacaaggagttacagatcgagtattggtcttgtttcacatacttgttcacctgtccaagcactctcagagcaaaagctgtcagccaggcactagagcttgctcccttccacatgctgtaggaatagtcagcgtttctgtaggacatgacgctcaccagcccttcttttatttttttctgcaggctctgttttctagctaacgtatcagggtggaaaatattccaatggtttcctgcttccaggtagtggaaaacgtagaacaccgggactatgctcatgagttctgcctcggcgctgcccttggggaggtgggttaggatgtcgatgccttctttactcagaaccgtggacaagaattcccctataagcagtccttttacactcaaaatccttttgacgttggttttggggaccaaatctaatggtatcctgtatgggaattcctttcgtctgttaacaataccataaactcccctggggtccagagtcacaccagcatagctttcccttttgatcccttctggcactacccgtaatgtcttcactaagatttctttcccaaatgaagtctctagtgagaagtttatggagtgaaggccaatttccagaggaagcaggctgaaggtcaccaagtgactggaggagccctctattctctggcgcacacatctggaggacctagaggtctgagggctagcagccgagcttcctggagtgcagattccctccacggcagacattttaacacagaacattgtcccagaggtcctataattgtaaacggttcccttcaattggatctgctcccctcgtacaacagaatatggtatgttcatctccaggaagacatctttgaacacctttgccttgagtgtgtcagcaacacatataccattgtctgagatgccgatgccttgaatttcccaggtcgtcagtgagtcaggcagtgcaacctgcagctggtttcttttgggaacacgatgaacttcccatagccagctctctggaaagtagcttcggatttctgccttcatcactggtaacagggcctttatttggatccttcccaacagcatgcctttgtggtggctttcttttcggatcttatccgcaatagtacaacactcgttgaaggccctgatgcagtgtgggcctatggtcacccgggcaactcgctgctcacaggtttcgtatttgttttctcgggctccatcataacagcatttcttgggcacacggtgtttgtatttagcagcttgttcttccactttctgatgcaggagctgcaggtctctctttggcctgagaatttccttacaagagtcatcgtggtattgggagtcatctgcgtttgcattggtgaggaaggtgagcccagctagatggaatacatctacattgtcacggccaccacctgccccacagcccaggtcactcttgtcatcaaaagcttggaacactctttgcatggcccttttggcttttccccggactccatacacagcgctgtccaccgcagatagtgccacccatgagtctgcttcagtcaccatgtcaagggacacagtttggcctggagaatacacgtctttatctggagacagatggacctggagctggttgccacacttctcctcaatgtttatccagactgcgtcagccaccaattctgctgtctgctcccccgtgactatgtaatagaccaggagccgcgctgaaggaaccatgtcctgtgtcactgggatgtttatattttgataagatgaatagagaagtttctcctttgtgccatactgtacaattttgcctttggataaaatcaagtaattatagtgagttattttgtcaatatatggactcttgggggtgacgataatattcagatattctcccacaagcatgggcttgtagttttcagtccagccaatgtaaatgtaactctggctgagggatgagtatgtaactgcttcatattctttgctggcttgattttcttcgggaagttccggggcatcagttttgacctcaaacttcagtgatgtcacttctgatgggaggttcaccacaaatgaagccactccatcagcagagtgtgtgatgctcctctttggttccaagtcagatgtctcttgattcacattgactgtttgtgccatcagagttactgggacccctcctaccaactgctcgagtgaatccttaacctgtaccttgatggaaaatggaatcccaggcttcaggaaaagaggggtagcgaccaaattcagtgtatagggagagaggacgtatttgatgccaggaatttctgcctcttccgaaaacccacctacaagggcagcaagcactgagttaatgtttccggaaagatgatggcgggctgtaggacatctgtcggtctctgtgctatccat

SEQ ID NO: 9 - protein, 16 aa, Artificial Sequence
  Description of Artificial Sequence: Synthetic peptide
AAVALLPAVLLALLAP

SEQ ID NO: 10 - protein, 11 aa, Artificial Sequence
  Description of Artificial Sequence: Synthetic peptide
AALLPVLLAAP

SEQ ID NO: 11 - protein, 13 aa, Human immunodeficiency virus
GRKKRRQRRRPPQ

SEQ ID NO: 12 - protein, 16 aa, Drosophila sp.
RQIKIWFQNRRMKWKK

SEQ ID NO: 13 - DNA, 21 bp, Artificial Sequence
  Description of Artificial Sequence: Synthetic oligonucleotide
  Description of Combined DNA/RNA Molecule: Synthetic oligonucleotide
cuuacgcugaguacuucgatt

SEQ ID NO: 14 - DNA, 21 bp, Artificial Sequence
  Description of Artificial Sequence: Synthetic oligonucleotide
  Description of Combined DNA/RNA Molecule: Synthetic oligonucleotide
ucgaaguacucagcguaagtt

SEQ ID NO: 15 - RNA, 21 nt, Homo sapiens
aauaacucacuauaauuacuu

SEQ ID NO: 16 - RNA, 21 nt, Homo sapiens
ugacaaaauaacucacuauaa

SEQ ID NO: 17 - RNA, 21 nt, Homo sapiens
cuuccucuggaaauuggccuu

SEQ ID NO: 18 - RNA, 21 nt, Homo sapiens
gacaaaauaacucacuauaau

SEQ ID NO: 19 - RNA, 21 nt, Homo sapiens
uccucuggaaauuggccuuca

SEQ ID NO: 20 - RNA, 21 nt, Homo sapiens
aagcaagauauuuuuauaaua

SEQ ID NO: 21 - RNA, 21 nt, Homo sapiens
aaaauguuuuugucaaguaca

SEQ ID NO: 22 - RNA, 21 nt, Homo sapiens
auuuaaacaacaaguaccuuu

SEQ ID NO: 23 - RNA, 21 nt, Homo sapiens
auucagaaagucugugaagga

SEQ ID NO: 24 - RNA, 21 nt, Homo sapiens
acacugaagcauuugaugcaa

SEQ ID NO: 25 - RNA, 21 nt, Homo sapiens
gcaguucuguguuaaaauguc

SEQ ID NO: 26 - RNA, 21 nt, Homo sapiens
aggauuuugaguguaaaagga

SEQ ID NO: 27 - RNA, 21 nt, Homo sapiens
aaugaugaaccuuguaaagaa

SEQ ID NO: 28 - RNA, 21 nt, Homo sapiens
aucauuggaacauuuuucauu

SEQ ID NO: 29 - RNA, 21 nt, Homo sapiens
agccagaaauucggaguuauu

SEQ ID NO: 30 - RNA, 21 nt, Homo sapiens
ucccugggagauaaaacucac

SEQ ID NO: 31 - RNA, 21 nt, Homo sapiens
gaaaaugaugaaccuuguaaa

SEQ ID NO: 32 - RNA, 21 nt, Homo sapiens
auugcucaagucacauuugau

SEQ ID NO: 33 - RNA, 21 nt, Homo sapiens
gagauugcauaugcuuauaaa

SEQ ID NO: 34 - RNA, 21 nt, Homo sapiens
guuauccugauaaaaaauuua

SEQ ID NO: 35 - RNA, 21 nt, Homo sapiens
aggaaguuugcagcuuuuauu

SEQ ID NO: 36 - RNA, 21 nt, Homo sapiens
gaagaaauugaucauauugga

SEQ ID NO: 37 - RNA, 21 nt, Homo sapiens
auccugauaaaaaauuuaguu

SEQ ID NO: 38 - RNA, 21 nt, Homo sapiens
uggaaaagaaaucuuaguaaa

SEQ ID NO: 39 - RNA, 21 nt, Homo sapiens
ucuuaucaaaguauaaacauu

SEQ ID NO: 40 - RNA, 21 nt, Homo sapiens
ucccuacaaacugaauuuggu

SEQ ID NO: 41 - RNA, 21 nt, Homo sapiens
caggagcaaacauaugucauu

SEQ ID NO: 42 - RNA, 21 nt, Homo sapiens
acauguaacaacuguaguuca

SEQ ID NO: 43 - RNA, 21 nt, Homo sapiens
caggaaaucauuggaacauuu

SEQ ID NO: 44 - RNA, 21 nt, Homo sapiens
uuuaagaauuuugaaauuacu

SEQ ID NO: 45 - RNA, 21 nt, Homo sapiens
uauucugcaacugaauucgau

SEQ ID NO: 46 - RNA, 21 nt, Homo sapiens
gcccuuggaaagaguauuuca

SEQ ID NO: 47 - RNA, 21 nt, Homo sapiens
ccugauaaaaaauuuaguuac

SEQ ID NO: 48 - RNA, 21 nt, Homo sapiens
cccuuggaaagaguauuucaa

SEQ ID NO: 49 - RNA, 21 nt, Mus musculus
ugcagaucaaacacaauuuca

SEQ ID NO: 50 - RNA, 21 nt, Mus musculus
cagaucaaacacaauuucagu

SEQ ID NO: 51 - RNA, 21 nt, Mus musculus
guuccggauauuugaacuuuu

SEQ ID NO: 52 - RNA, 21 nt, Homo sapiens
auuuaaacaacaaguaccuuu

SEQ ID NO: 53 - RNA, 21 nt, Homo sapiens
auuuaaacaacaaguaccuuu

SEQ ID NO: 54 - RNA, 21 nt, Homo sapiens
ugacaaaauaacucacuauaa

SEQ ID NO: 55 - RNA, 21 nt, Homo sapiens
ugacaaaauaacucacuauaa

SEQ ID NO: 56 - RNA, 21 nt, Homo sapiens
gacaaaauaacucacuauaau

SEQ ID NO: 57 - RNA, 21 nt, Homo sapiens
gacaaaauaacucacuauaau

SEQ ID NO: 58 - RNA, 21 nt, Mus musculus
guuccggauauuugaacuuuu

SEQ ID NO: 59 - RNA, 21 nt, Mus musculus
guuccggauauuugaacuuuu

SEQ ID NO: 60 - RNA, 21 nt, Mus musculus
ugcagaucaaacacaauuuca

SEQ ID NO: 61 - RNA, 21 nt, Mus musculus
ugcagaucaaacacaauuuca

SEQ ID NO: 62 - RNA, 21 nt, Homo sapiens
aagcaagauauuuuuauaaua

SEQ ID NO: 63 - RNA, 21 nt, Homo sapiens
aagcaagauauuuuuauaaua

SEQ ID NO: 64 - RNA, 21 nt, Mus musculus
cagaucaaacacaauuucagu

SEQ ID NO: 65 - RNA, 21 nt, Mus musculus
cagaucaaacacaauuucagu

SEQ ID NO: 66 - RNA, 23 nt, Homo sapiens
aaguaauuauagugaguuauuuu

SEQ ID NO: 67 - RNA, 23 nt, Homo sapiens
uuauagugaguuauuuugucaau

SEQ ID NO: 68 - RNA, 23 nt, Homo sapiens
aaggccaauuuccagaggaagca

SEQ ID NO: 69 - RNA, 23 nt, Homo sapiens
auuauagugaguuauuuugucaa

SEQ ID NO: 70 - RNA, 23 nt, Homo sapiens
ugaaggccaauuuccagaggaag

SEQ ID NO: 71 - RNA, 23 nt, Homo sapiens
uauuauaaaaauaucuugcuuuu

SEQ ID NO: 72 - RNA, 23 nt, Homo sapiens
uguacuugacaaaaacauuuucu

SEQ ID NO: 73 - RNA, 23 nt, Homo sapiens
aaagguacuuguuguuuaaaucu

SEQ ID NO: 74 - RNA, 23 nt, Homo sapiens
uccuucacagacuuucugaauuu

SEQ ID NO: 75 - RNA, 23 nt, Homo sapiens
uugcaucaaaugcuucaguguau

SEQ ID NO: 76 - RNA, 23 nt, Homo sapiens
gacauuuuaacacagaacugcau

SEQ ID NO: 77 - RNA, 23 nt, Homo sapiens
uccuuuuacacucaaaauccuuu

SEQ ID NO: 78 - RNA, 23 nt, Homo sapiens
uucuuuacaagguucaucauuuu

SEQ ID NO: 79 - RNA, 23 nt, Homo sapiens
aaugaaaaauguuccaaugauuu

SEQ ID NO: 80 - RNA, 23 nt, Homo sapiens
aauaacuccgaauuucuggcuug

SEQ ID NO: 81 - RNA, 23 nt, Homo sapiens
gugaguuuuaucucccagggaaa

SEQ ID NO: 82 - RNA, 23 nt, Homo sapiens
uuuacaagguucaucauuuucuu

SEQ ID NO: 83 - RNA, 23 nt, Homo sapiens
aucaaaugugacuugagcaauuc

SEQ ID NO: 84 - RNA, 23 nt, Homo sapiens
uuuauaagcauaugcaaucucug

SEQ ID NO: 85 - RNA, 23 nt, Homo sapiens
uaaauuuuuuaucaggauaacuu

SEQ ID NO: 86 - RNA, 23 nt, Homo sapiens
aauaaaagcugcaaacuuccuca

SEQ ID NO: 87 - RNA, 23 nt, Homo sapiens
uccaauaugaucaauuucuucua

SEQ ID NO: 88 - RNA, 23 nt, Homo sapiens
aacuaaauuuuuuaucaggauaa

SEQ ID NO: 89 - RNA, 23 nt, Homo sapiens
uuuacuaagauuucuuuuccaaa

SEQ ID NO: 90 - RNA, 23 nt, Homo sapiens
aauguuuauacuuugauaagaug

SEQ ID NO: 91 - RNA, 23 nt, Homo sapiens
accaaauucaguuuguagggaga

SEQ ID NO: 92 - RNA, 23 nt, Homo sapiens
aaugacauauguuugcuccuguc

SEQ ID NO: 93 - RNA, 23 nt, Homo sapiens
ugaacuacaguuguuacauguac

SEQ ID NO: 94 - RNA, 23 nt, Homo sapiens
aaauguuccaaugauuuccuguu

SEQ ID NO: 95 - RNA, 23 nt, Homo sapiens
aguaauuucaaaauucuuaaagu

SEQ ID NO: 96 - RNA, 23 nt, Homo sapiens
aucgaauucaguugcagaauaac

SEQ ID NO: 97 - RNA, 23 nt, Homo sapiens
ugaaauacucuuuccaagggcuu

SEQ ID NO: 98 - RNA, 23 nt, Homo sapiens
guaacuaaauuuuuuaucaggau

SEQ ID NO: 99 - RNA, 23 nt, Homo sapiens
uugaaauacucuuuccaagggcu

SEQ ID NO: 100 - RNA, 23 nt, Mus musculus
ugaaauuguguuugaucugcaga

SEQ ID NO: 101 - RNA, 23 nt, Mus musculus
acugaaauuguguuugaucugca

SEQ ID NO: 102 - RNA, 23 nt, Mus musculus
aaaaguucaaauauccggaaccg

SEQ ID NO: 103 - RNA, 23 nt, Homo sapiens
aaagguacuuguuguuuaaaucu

SEQ ID NO: 104 - RNA, 23 nt, Homo sapiens
aaagguacuuguuguuuaaaucu

SEQ ID NO: 105 - RNA, 23 nt, Homo sapiens
uuauagugaguuauuuugucaau

SEQ ID NO: 106 - RNA, 23 nt, Homo sapiens
uuauagugaguuauuuugucaau

SEQ ID NO: 107 - RNA, 23 nt, Homo sapiens
auuauagugaguuauuuugucaa

SEQ ID NO: 108 - RNA, 23 nt, Homo sapiens
auuauagugaguuauuuugucaa

SEQ ID NO: 109 - RNA, 23 nt, Mus musculus
aaaaguucaaauauccggaaccg

SEQ ID NO: 110 - RNA, 23 nt, Mus musculus
aaaaguucaaauauccggaaccg

SEQ ID NO: 111 - RNA, 23 nt, Mus musculus
ugaaauuguguuugaucugcaga

SEQ ID NO: 112 - RNA, 23 nt, Mus musculus
ugaaauuguguuugaucugcaga

SEQ ID NO: 113 - RNA, 23 nt, Homo sapiens
uauuauaaaaauaucuugcuuuu

SEQ ID NO: 114 - RNA, 23 nt, Homo sapiens
uauuauaaaaauaucuugcuuuu

SEQ ID NO: 115 - RNA, 23 nt, Mus musculus
acugaaauuguguuugaucugca

SEQ ID NO: 116 - RNA, 23 nt, Mus musculus
acugaaauuguguuugaucugca

SEQ ID NO: 117 - RNA, 21 nt, Artificial Sequence
  Description of Artificial Sequence: Synthetic oligonucleotide
aauaacucacuauaauuacuu

SEQ ID NO: 118 - RNA, 21 nt, Artificial Sequence
  Description of Artificial Sequence: Synthetic oligonucleotide
ugacaaaauaacucacuauaa

SEQ ID NO: 119 - RNA, 21 nt, Artificial Sequence
  Description of Artificial Sequence: Synthetic oligonucleotide
cuuccucuggaaauuggccuu

SEQ ID NO: 120 - RNA, 21 nt, Artificial Sequence
  Description of Artificial Sequence: Synthetic oligonucleotide
gacaaaauaacucacuauaau

SEQ ID NO: 121 - RNA, 21 nt, Artificial Sequence
  Description of Artificial Sequence: Synthetic oligonucleotide
uccucuggaaauuggccuuca

SEQ ID NO: 122 - RNA, 21 nt, Artificial Sequence
  Description of Artificial Sequence: Synthetic oligonucleotide
aagcaagauauuuuuauaaua

SEQ ID NO: 123 - RNA, 21 nt, Artificial Sequence
  Description of Artificial Sequence: Synthetic oligonucleotide
aaaauguuuuugucaaguaca

SEQ ID NO: 124 - RNA, 21 nt, Artificial Sequence
  Description of Artificial Sequence: Synthetic oligonucleotide
auuuaaacaacaaguaccuuu

SEQ ID NO: 125 - RNA, 21 nt, Artificial Sequence
  Description of Artificial Sequence: Synthetic oligonucleotide
auucagaaagucugugaagga

SEQ ID NO: 126 - RNA, 21 nt, Artificial Sequence
  Description of Artificial Sequence: Synthetic oligonucleotide
acacugaagcauuugaugcaa

SEQ ID NO: 127 - RNA, 21 nt, Artificial Sequence
  Description of Artificial Sequence: Synthetic oligonucleotide
gcaguucuguguuaaaauguc

SEQ ID NO: 128 - RNA, 21 nt, Artificial Sequence
  Description of Artificial Sequence: Synthetic oligonucleotide
aggauuuugaguguaaaagga

SEQ ID NO: 129 - RNA, 21 nt, Artificial Sequence
  Description of Artificial Sequence: Synthetic oligonucleotide
aaugaugaaccuuguaaagaa

SEQ ID NO: 130 - RNA, 21 nt, Artificial Sequence
  Description of Artificial Sequence: Synthetic oligonucleotide
aucauuggaacauuuuucauu

SEQ ID NO: 131 - RNA, 21 nt, Artificial Sequence
  Description of Artificial Sequence: Synthetic oligonucleotide
agccagaaauucggaguuauu

SEQ ID NO: 132 - RNA, 21 nt, Artificial Sequence
  Description of Artificial Sequence: Synthetic oligonucleotide
ucccugggagauaaaacucac

SEQ ID NO: 133 - RNA, 21 nt, Artificial Sequence
  Description of Artificial Sequence: Synthetic oligonucleotide
gaaaaugaugaaccuuguaaa

SEQ ID NO: 134 - RNA, 21 nt, Artificial Sequence
  Description of Artificial Sequence: Synthetic oligonucleotide
auugcucaagucacauuugau

SEQ ID NO: 135 - RNA, 21 nt, Artificial Sequence
  Description of Artificial Sequence: Synthetic oligonucleotide
gagauugcauaugcuuauaaa

SEQ ID NO: 136 - RNA, 21 nt, Artificial Sequence
  Description of Artificial Sequence: Synthetic oligonucleotide
guuauccugauaaaaaauuua

SEQ ID NO: 137 - RNA, 21 nt, Artificial Sequence
  Description of Artificial Sequence: Synthetic oligonucleotide
aggaaguuugcagcuuuuauu

SEQ ID NO: 138 - RNA, 21 nt, Artificial Sequence
  Description of Artificial Sequence: Synthetic oligonucleotide
gaagaaauugaucauauugga

SEQ ID NO: 139 - RNA, 21 nt, Artificial Sequence
  Description of Artificial Sequence: Synthetic oligonucleotide
auccugauaaaaaauuuaguu

SEQ ID NO: 140 - RNA, 21 nt, Artificial Sequence
  Description of Artificial Sequence: Synthetic oligonucleotide
uggaaaagaaaucuuaguaaa

SEQ ID NO: 141 - RNA, 21 nt, Artificial Sequence
  Description of Artificial Sequence: Synthetic oligonucleotide
ucuuaucaaaguauaaacauu

SEQ ID NO: 142 - RNA, 21 nt, Artificial Sequence
  Description of Artificial Sequence: Synthetic oligonucleotide
ucccuacaaacugaauuuggu

SEQ ID NO: 143 - RNA, 21 nt, Artificial Sequence
  Description of Artificial Sequence: Synthetic oligonucleotide
caggagcaaacauaugucauu

SEQ ID NO: 144 - RNA, 21 nt, Artificial Sequence
  Description of Artificial Sequence: Synthetic oligonucleotide
acauguaacaacuguaguuca

SEQ ID NO: 145 - RNA, 21 nt, Artificial Sequence
  Description of Artificial Sequence: Synthetic oligonucleotide
caggaaaucauuggaacauuu

SEQ ID NO: 146 - RNA, 21 nt, Artificial Sequence
  Description of Artificial Sequence: Synthetic oligonucleotide
uuuaagaauuuugaaauuacu

SEQ ID NO: 147 - RNA, 21 nt, Artificial Sequence
  Description of Artificial Sequence: Synthetic oligonucleotide
uauucugcaacugaauucgau

SEQ ID NO: 148 - RNA, 21 nt, Artificial Sequence
  Description of Artificial Sequence: Synthetic oligonucleotide
gcccuuggaaagaguauuuca

SEQ ID NO: 149 - RNA, 21 nt, Artificial Sequence
  Description of Artificial Sequence: Synthetic oligonucleotide
ccugauaaaaaauuuaguuac

SEQ ID NO: 150 - RNA, 21 nt, Artificial Sequence
  Description of Artificial Sequence: Synthetic oligonucleotide
cccuuggaaagaguauuucaa

SEQ ID NO: 151 - RNA, 21 nt, Artificial Sequence
  Description of Artificial Sequence: Synthetic oligonucleotide
ugcagaucaaacacaauuuca

SEQ ID NO: 152 - RNA, 21 nt, Artificial Sequence
  Description of Artificial Sequence: Synthetic oligonucleotide
cagaucaaacacaauuucagu

SEQ ID NO: 153 - RNA, 21 nt, Artificial Sequence
  Description of Artificial Sequence: Synthetic oligonucleotide
guuccggauauuugaacuuuu

SEQ ID NO: 154 - RNA, 21 nt, Artificial Sequence
  Description of Artificial Sequence: Synthetic oligonucleotide
auuuaaacaacaaguaccuuu

SEQ ID NO: 155 - RNA, 21 nt, Artificial Sequence
  Description of Artificial Sequence: Synthetic oligonucleotide
auuuaaacaacaaguaccuuu

SEQ ID NO: 156 - RNA, 21 nt, Artificial Sequence
  Description of Artificial Sequence: Synthetic oligonucleotide
ugacaaaauaacucacuauaa

SEQ ID NO: 157 - RNA, 21 nt, Artificial Sequence
  Description of Artificial Sequence: Synthetic oligonucleotide
ugacaaaauaacucacuauaa

SEQ ID NO: 158 - RNA, 21 nt, Artificial Sequence
  Description of Artificial Sequence: Synthetic oligonucleotide
gacaaaauaacucacuauaau

SEQ ID NO: 159 - RNA, 21 nt, Artificial Sequence
  Description of Artificial Sequence: Synthetic oligonucleotide
gacaaaauaacucacuauaau

SEQ ID NO: 160 - RNA, 21 nt, Artificial Sequence
  Description of Artificial Sequence: Synthetic oligonucleotide
guuccggauauuugaacuuuu

SEQ ID NO: 161 - RNA, 21 nt, Artificial Sequence
  Description of Artificial Sequence: Synthetic oligonucleotide
guuccggauauuugaacuuuu

SEQ ID NO: 162 - RNA, 21 nt, Artificial Sequence
  Description of Artificial Sequence: Synthetic oligonucleotide
ugcagaucaaacacaauuuca

SEQ ID NO: 163 - RNA, 21 nt, Artificial Sequence
  Description of Artificial Sequence: Synthetic oligonucleotide
ugcagaucaaacacaauuuca

SEQ ID NO: 164 - RNA, 21 nt, Artificial Sequence
  Description of Artificial Sequence: Synthetic oligonucleotide
aagcaagauauuuuuauaaua

SEQ ID NO: 165 - RNA, 21 nt, Artificial Sequence
  Description of Artificial Sequence: Synthetic oligonucleotide
aagcaagauauuuuuauaaua

SEQ ID NO: 166 - RNA, 21 nt, Artificial Sequence
  Description of Artificial Sequence: Synthetic oligonucleotide
cagaucaaacacaauuucagu

SEQ ID NO: 167 - RNA, 21 nt, Artificial Sequence
  Description of Artificial Sequence: Synthetic oligonucleotide
cagaucaaacacaauuucagu

SEQ ID NO: 168 - RNA, 23 nt, Artificial Sequence
  Description of Artificial Sequence: Synthetic oligonucleotide
aaguaauuauagugaguuauuuu

SEQ ID NO: 169 - RNA, 23 nt, Artificial Sequence
  Description of Artificial Sequence: Synthetic oligonucleotide
uuauagugaguuauuuugucaau

SEQ ID NO: 170 - RNA, 23 nt, Artificial Sequence
  Description of Artificial Sequence: Synthetic oligonucleotide
aaggccaauuuccagaggaagca

SEQ ID NO: 171 - RNA, 23 nt, Artificial Sequence
  Description of Artificial Sequence: Synthetic oligonucleotide
auuauagugaguuauuuugucaa

SEQ ID NO: 172 - RNA, 23 nt, Artificial Sequence
  Description of Artificial Sequence: Synthetic oligonucleotide
ugaaggccaauuuccagaggaag

SEQ ID NO: 173 - RNA, 23 nt, Artificial Sequence
  Description of Artificial Sequence: Synthetic oligonucleotide
uauuauaaaaauaucuugcuuuu

SEQ ID NO: 174 - RNA, 23 nt, Artificial Sequence
  Description of Artificial Sequence: Synthetic oligonucleotide
uguacuugacaaaaacauuuucu

SEQ ID NO: 175 - RNA, 23 nt, Artificial Sequence
  Description of Artificial Sequence: Synthetic oligonucleotide
aaagguacuuguuguuuaaaucu

SEQ ID NO: 176 - RNA, 23 nt, Artificial Sequence
  Description of Artificial Sequence: Synthetic oligonucleotide
uccuucacagacuuucugaauuu

SEQ ID NO: 177 - RNA, 23 nt, Artificial Sequence
  Description of Artificial Sequence: Synthetic oligonucleotide
uugcaucaaaugcuucaguguau

SEQ ID NO: 178 - RNA, 23 nt, Artificial Sequence
  Description of Artificial Sequence: Synthetic oligonucleotide
gacauuuuaacacagaacugcau

SEQ ID NO: 179 - RNA, 23 nt, Artificial Sequence
  Description of Artificial Sequence: Synthetic oligonucleotide
uccuuuuacacucaaaauccuuu

SEQ ID NO: 180 - RNA, 23 nt, Artificial Sequence
  Description of Artificial Sequence: Synthetic oligonucleotide
uucuuuacaagguucaucauuuu

SEQ ID NO: 181 - RNA, 23 nt, Artificial Sequence
  Description of Artificial Sequence: Synthetic oligonucleotide
aaugaaaaauguuccaaugauuu

SEQ ID NO: 182 - RNA, 23 nt, Artificial Sequence
  Description of Artificial Sequence: Synthetic oligonucleotide
aauaacuccgaauuucuggcuug

SEQ ID NO: 183 - RNA, 23 nt, Artificial Sequence
  Description of Artificial Sequence: Synthetic oligonucleotide
gugaguuuuaucucccagggaaa

SEQ ID NO: 184 - RNA, 23 nt, Artificial Sequence
  Description of Artificial Sequence: Synthetic oligonucleotide
uuuacaagguucaucauuuucuu

SEQ ID NO: 185 - RNA, 23 nt, Artificial Sequence
  Description of Artificial Sequence: Synthetic oligonucleotide
aucaaaugugacuugagcaauuc

SEQ ID NO: 186 - RNA, 23 nt, Artificial Sequence
  Description of Artificial Sequence: Synthetic oligonucleotide
uuuauaagcauaugcaaucucug

SEQ ID NO: 187 - RNA, 23 nt, Artificial Sequence
  Description of Artificial Sequence: Synthetic oligonucleotide
uaaauuuuuuaucaggauaacuu

SEQ ID NO: 188 - RNA, 23 nt, Artificial Sequence
  Description of Artificial Sequence: Synthetic oligonucleotide
aauaaaagcugcaaacuuccuca

SEQ ID NO: 189 - RNA, 23 nt, Artificial Sequence
  Description of Artificial Sequence: Synthetic oligonucleotide
uccaauaugaucaauuucuucua

SEQ ID NO: 190 - RNA, 23 nt, Artificial Sequence
  Description of Artificial Sequence: Synthetic oligonucleotide
aacuaaauuuuuuaucaggauaa

SEQ ID NO: 191 - RNA, 23 nt, Artificial Sequence
  Description of Artificial Sequence: Synthetic oligonucleotide
uuuacuaagauuucuuuuccaaa

SEQ ID NO: 192 - RNA, 23 nt, Artificial Sequence
  Description of Artificial Sequence: Synthetic oligonucleotide
aauguuuauacuuugauaagaug

SEQ ID NO: 193 - RNA, 23 nt, Artificial Sequence
  Description of Artificial Sequence: Synthetic oligonucleotide
accaaauucaguuuguagggaga

SEQ ID NO: 194 - RNA, 23 nt, Artificial Sequence
  Description of Artificial Sequence: Synthetic oligonucleotide
aaugacauauguuugcuccuguc

SEQ ID NO: 195 - RNA, 23 nt, Artificial Sequence
  Description of Artificial Sequence: Synthetic oligonucleotide
ugaacuacaguuguuacauguac

SEQ ID NO: 196 - RNA, 23 nt, Artificial Sequence
  Description of Artificial Sequence: Synthetic oligonucleotide
aaauguuccaaugauuuccuguu

SEQ ID NO: 197 - RNA, 23 nt, Artificial Sequence
  Description of Artificial Sequence: Synthetic oligonucleotide
aguaauuucaaaauucuuaaagu

SEQ ID NO: 198 - RNA, 23 nt, Artificial Sequence
  Description of Artificial Sequence: Synthetic oligonucleotide
aucgaauucaguugcagaauaac

SEQ ID NO: 199 - RNA, 23 nt, Artificial Sequence
  Description of Artificial Sequence: Synthetic oligonucleotide
ugaaauacucuuuccaagggcuu

SEQ ID NO: 200 - RNA, 23 nt, Artificial Sequence
  Description of Artificial Sequence: Synthetic oligonucleotide
guaacuaaauuuuuuaucaggau

SEQ ID NO: 201 - RNA, 23 nt, Artificial Sequence
  Description of Artificial Sequence: Synthetic oligonucleotide
uugaaauacucuuuccaagggcu

SEQ ID NO: 202 - RNA, 23 nt, Artificial Sequence
  Description of Artificial Sequence: Synthetic oligonucleotide
ugaaauuguguuugaucugcaga

SEQ ID NO: 203 - RNA, 23 nt, Artificial Sequence
  Description of Artificial Sequence: Synthetic oligonucleotide
acugaaauuguguuugaucugca

SEQ ID NO: 204 - RNA, 23 nt, Artificial Sequence
  Description of Artificial Sequence: Synthetic oligonucleotide
aaaaguucaaauauccggaaccg

SEQ ID NO: 205 - RNA, 23 nt, Artificial Sequence
  Description of Artificial Sequence: Synthetic oligonucleotide
aaagguacuuguuguuuaaaucu

SEQ ID NO: 206 - RNA, 23 nt, Artificial Sequence
  Description of Artificial Sequence: Synthetic oligonucleotide
aaagguacuuguuguuuaaaucu

SEQ ID NO: 207 - RNA, 23 nt, Artificial Sequence
  Description of Artificial Sequence: Synthetic oligonucleotide
uuauagugaguuauuuugucaau

SEQ ID NO: 208 - RNA, 23 nt, Artificial Sequence
  Description of Artificial Sequence: Synthetic oligonucleotide
uuauagugaguuauuuugucaau

SEQ ID NO: 209 - RNA, 23 nt, Artificial Sequence
  Description of Artificial Sequence: Synthetic oligonucleotide
auuauagugaguuauuuugucaa

SEQ ID NO: 210 - RNA, 23 nt, Artificial Sequence
  Description of Artificial Sequence: Synthetic oligonucleotide
auuauagugaguuauuuugucaa

SEQ ID NO: 211 - RNA, 23 nt, Artificial Sequence
  Description of Artificial Sequence: Synthetic oligonucleotide
aaaaguucaaauauccggaaccg

SEQ ID NO: 212 - RNA, 23 nt, Artificial Sequence
  Description of Artificial Sequence: Synthetic oligonucleotide
aaaaguucaaauauccggaaccg

SEQ ID NO: 213 - RNA, 23 nt, Artificial Sequence
  Description of Artificial Sequence: Synthetic oligonucleotide
ugaaauuguguuugaucugcaga

SEQ ID NO: 214 - RNA, 23 nt, Artificial Sequence
  Description of Artificial Sequence: Synthetic oligonucleotide
ugaaauuguguuugaucugcaga

SEQ ID NO: 215 - RNA, 23 nt, Artificial Sequence
  Description of Artificial Sequence: Synthetic oligonucleotide
uauuauaaaaauaucuugcuuuu

SEQ ID NO: 216 - RNA, 23 nt, Artificial Sequence
  Description of Artificial Sequence: Synthetic oligonucleotide
uauuauaaaaauaucuugcuuuu

SEQ ID NO: 217 - RNA, 23 nt, Artificial Sequence
  Description of Artificial Sequence: Synthetic oligonucleotide
acugaaauuguguuugaucugca

SEQ ID NO: 218 - RNA, 23 nt, Artificial Sequence
  Description of Artificial Sequence: Synthetic oligonucleotide
acugaaauuguguuugaucugca

SEQ ID NO: 219 - RNA, 19 nt, Homo sapiens
cacuauaauuacuugauuu

SEQ ID NO: 220 - RNA, 19 nt, Homo sapiens
uaacucacuauaauuacuu

SEQ ID NO: 221 - RNA, 19 nt, Homo sapiens
acaaaauaacucacuauaa

SEQ ID NO: 222 - RNA, 19 nt, Homo sapiens
uccucuggaaauuggccuu

SEQ ID NO: 223 - RNA, 19 nt, Homo sapiens
caaaauaacucacuauaau

SEQ ID NO: 224 - RNA, 19 nt, Homo sapiens
cucuggaaauuggccuuca

SEQ ID NO: 225 - RNA, 19 nt, Homo sapiens
gcaagauauuuuuauaaua

SEQ ID NO: 226 - RNA, 19 nt, Homo sapiens
aauguuuuugucaaguaca

SEQ ID NO: 227 - RNA, 19 nt, Homo sapiens
uuaaacaacaaguaccuuu

SEQ ID NO: 228 - RNA, 19 nt, Homo sapiens
ucagaaagucugugaagga

SEQ ID NO: 229 - RNA, 19 nt, Homo sapiens
acugaagcauuugaugcaa

SEQ ID NO: 230 - RNA, 19 nt, Homo sapiens
aguucuguguuaaaauguc

SEQ ID NO: 231 - RNA, 19 nt, Homo sapiens
gauuuugaguguaaaagga

SEQ ID NO: 232 - RNA, 19 nt, Homo sapiens
ugaugaaccuuguaaagaa

SEQ ID NO: 233 - RNA, 19 nt, Homo sapiens
cauuggaacauuuuucauu

SEQ ID NO: 234 - RNA, 19 nt, Homo sapiens
ccagaaauucggaguuauu

SEQ ID NO: 235 - RNA, 19 nt, Homo sapiens
ccugggagauaaaacucac

SEQ ID NO: 236 - RNA, 19 nt, Homo sapiens
aaaugaugaaccuuguaaa

SEQ ID NO: 237 - RNA, 19 nt, Homo sapiens
ugcucaagucacauuugau

SEQ ID NO: 238 - RNA, 19 nt, Homo sapiens
gauugcauaugcuuauaaa

SEQ ID NO: 239 - RNA, 19 nt, Homo sapiens
uauccugauaaaaaauuua

SEQ ID NO: 240 - RNA, 19 nt, Homo sapiens
gaaguuugcagcuuuuauu

SEQ ID NO: 241 - RNA, 19 nt, Homo sapiens
agaaauugaucauauugga

SEQ ID NO: 242 - RNA, 19 nt, Homo sapiens
ccugauaaaaaauuuaguu

SEQ ID NO: 243 - RNA, 19 nt, Homo sapiens
gaaaagaaaucuuaguaaa

SEQ ID NO: 244 - RNA, 19 nt, Homo sapiens
uuaucaaaguauaaacauu

SEQ ID NO: 245 - RNA, 19 nt, Homo sapiens
ccuacaaacugaauuuggu

SEQ ID NO: 246 - RNA, 19 nt, Homo sapiens
ggagcaaacauaugucauu

SEQ ID NO: 247 - RNA, 19 nt, Homo sapiens
auguaacaacuguaguuca

SEQ ID NO: 248 - RNA, 19 nt, Homo sapiens
ggaaaucauuggaacauuu

SEQ ID NO: 249 - RNA, 19 nt, Homo sapiens
uaagaauuuugaaauuacu

SEQ ID NO: 250 - RNA, 19 nt, Homo sapiens
uucugcaacugaauucgau

SEQ ID NO: 251 - RNA, 19 nt, Homo sapiens
ccuuggaaagaguauuuca

SEQ ID NO: 252 - RNA, 19 nt, Homo sapiens
ugauaaaaaauuuaguuac

SEQ ID NO: 253 - RNA, 19 nt, Homo sapiens
cuuggaaagaguauuucaa

SEQ ID NO: 254 - RNA, 19 nt, Homo sapiens
cacuauaauuacuugauuu

SEQ ID NO: 255 - RNA, 19 nt, Homo sapiens
uaacucacuauaauuacuu

SEQ ID NO: 256 - RNA, 19 nt, Homo sapiens
acaaaauaacucacuauaa

SEQ ID NO: 257 - RNA, 19 nt, Homo sapiens
uccucuggaaauuggccuu

SEQ ID NO: 258 - RNA, 19 nt, Homo sapiens
caaaauaacucacuauaau

SEQ ID NO: 259 - RNA, 19 nt, Homo sapiens
cucuggaaauuggccuuca

SEQ ID NO: 260 - RNA, 19 nt, Homo sapiens
gcaagauauuuuuauaaua

SEQ ID NO: 261 - RNA, 19 nt, Homo sapiens
aauguuuuugucaaguaca

SEQ ID NO: 262 - RNA, 19 nt, Homo sapiens
uuaaacaacaaguaccuuu

SEQ ID NO: 263 - RNA, 19 nt, Homo sapiens
ucagaaagucugugaagga

SEQ ID NO: 264 - RNA, 19 nt, Homo sapiens
acugaagcauuugaugcaa

SEQ ID NO: 265 - RNA, 19 nt, Homo sapiens
aguucuguguuaaaauguc

SEQ ID NO: 266 - RNA, 19 nt, Homo sapiens
cacuauaauuacuugauuu

SEQ ID NO: 267 - RNA, 19 nt, Homo sapiens
uaacucacuauaauuacuu

SEQ ID NO: 268 - RNA, 19 nt, Homo sapiens
acaaaauaacucacuauaa

SEQ ID NO: 269 - RNA, 19 nt, Homo sapiens
uccucuggaaauuggccuu

SEQ ID NO: 270 - RNA, 19 nt, Homo sapiens
caaaauaacucacuauaau

SEQ ID NO: 271 - RNA, 19 nt, Homo sapiens
cucuggaaauuggccuuca

SEQ ID NO: 272 - RNA, 19 nt, Homo sapiens
gcaagauauuuuuauaaua

SEQ ID NO: 273 - RNA, 19 nt, Homo sapiens
aauguuuuugucaaguaca

SEQ ID NO: 274 - RNA, 19 nt, Homo sapiens
uuaaacaacaaguaccuuu

SEQ ID NO: 275 - RNA, 19 nt, Homo sapiens
ucagaaagucugugaagga

SEQ ID NO: 276 - RNA, 19 nt, Homo sapiens
acugaagcauuugaugcaa

SEQ ID NO: 277 - RNA, 19 nt, Homo sapiens
aguucuguguuaaaauguc

SEQ ID NO: 278 - RNA, 19 nt, Homo sapiens
cacuauaauuacuugauuu

SEQ ID NO: 279 - RNA, 19 nt, Homo sapiens
uaacucacuauaauuacuu

SEQ ID NO: 280 - RNA, 19 nt, Homo sapiens
acaaaauaacucacuauaa

SEQ ID NO: 281 - RNA, 19 nt, Homo sapiens
uccucuggaaauuggccuu

SEQ ID NO: 282 - RNA, 19 nt, Homo sapiens
caaaauaacucacuauaau

SEQ ID NO: 283 - RNA, 19 nt, Homo sapiens
cucuggaaauuggccuuca

SEQ ID NO: 284 - RNA, 19 nt, Homo sapiens
gcaagauauuuuuauaaua

SEQ ID NO: 285 - RNA, 19 nt, Homo sapiens
aauguuuuugucaaguaca

SEQ ID NO: 286 - RNA, 19 nt, Homo sapiens
uuaaacaacaaguaccuuu

SEQ ID NO: 287 - RNA, 19 nt, Homo sapiens
ucagaaagucugugaagga

SEQ ID NO: 288 - RNA, 19 nt, Homo sapiens
acugaagcauuugaugcaa

SEQ ID NO: 289 - RNA, 19 nt, Homo sapiens
aguucuguguuaaaauguc

SEQ ID NO: 290 - RNA, 19 nt, Homo sapiens
cacuauaauuacuugauuu

SEQ ID NO: 291 - RNA, 19 nt, Homo sapiens
uaacucacuauaauuacuu

SEQ ID NO: 292 - RNA, 19 nt, Homo sapiens
acaaaauaacucacuauaa

SEQ ID NO: 293 - RNA, 19 nt, Homo sapiens
uccucuggaaauuggccuu

SEQ ID NO: 294 - RNA, 19 nt, Homo sapiens
caaaauaacucacuauaau

SEQ ID NO: 295 - RNA, 19 nt, Homo sapiens
cucuggaaauuggccuuca

SEQ ID NO: 296 - RNA, 19 nt, Homo sapiens
gcaagauauuuuuauaaua

SEQ ID NO: 297 - RNA, 19 nt, Homo sapiens
aauguuuuugucaaguaca

SEQ ID NO: 298 - RNA, 19 nt, Homo sapiens
uuaaacaacaaguaccuuu

SEQ ID NO: 299 - RNA, 19 nt, Homo sapiens
ucagaaagucugugaagga

SEQ ID NO: 300 - RNA, 19 nt, Homo sapiens
acugaagcauuugaugcaa

SEQ ID NO: 301 - RNA, 19 nt, Homo sapiens
aguucuguguuaaaauguc

SEQ ID NO: 302 - RNA, 19 nt, Homo sapiens
aaaucaaguaauuauagug

SEQ ID NO: 303 - RNA, 19 nt, Homo sapiens
aaguaauuauagugaguua

SEQ ID NO: 304 - RNA, 19 nt, Homo sapiens
uuauagugaguuauuuugu

SEQ ID NO: 305 - RNA, 19 nt, Homo sapiens
aaggccaauuuccagagga

SEQ ID NO: 306 - RNA, 19 nt, Homo sapiens
auuauagugaguuauuuug

SEQ ID NO: 307 - RNA, 19 nt, Homo sapiens
ugaaggccaauuuccagag

SEQ ID NO: 308 - RNA, 19 nt, Homo sapiens
uauuauaaaaauaucuugc

SEQ ID NO: 309 - RNA, 19 nt, Homo sapiens
uguacuugacaaaaacauu

SEQ ID NO: 310 - RNA, 19 nt, Homo sapiens
aaagguacuuguuguuuaa

SEQ ID NO: 311 - RNA, 19 nt, Homo sapiens
uccuucacagacuuucuga

SEQ ID NO: 312 - RNA, 19 nt, Homo sapiens
uugcaucaaaugcuucagu

SEQ ID NO: 313 - RNA, 19 nt, Homo sapiens
gacauuuuaacacagaacu

SEQ ID NO: 314 - RNA, 19 nt, Homo sapiens
uccuuuuacacucaaaauc

SEQ ID NO: 315 - RNA, 19 nt, Homo sapiens
uucuuuacaagguucauca

SEQ ID NO: 316 - RNA, 19 nt, Homo sapiens
aaugaaaaauguuccaaug

SEQ ID NO: 317 - RNA, 19 nt, Homo sapiens
aauaacuccgaauuucugg

SEQ ID NO: 318 - RNA, 19 nt, Homo sapiens
gugaguuuuaucucccagg

SEQ ID NO: 319 - RNA, 19 nt, Homo sapiens
uuuacaagguucaucauuu

SEQ ID NO: 320 - RNA, 19 nt, Homo sapiens
aucaaaugugacuugagca

SEQ ID NO: 321 - RNA, 19 nt, Homo sapiens
uuuauaagcauaugcaauc

SEQ ID NO: 322 - RNA, 19 nt, Homo sapiens
uaaauuuuuuaucaggaua

SEQ ID NO: 323 - RNA, 19 nt, Homo sapiens
aauaaaagcugcaaacuuc

SEQ ID NO: 324 - RNA, 19 nt, Homo sapiens
uccaauaugaucaauuucu

SEQ ID NO: 325 - RNA, 19 nt, Homo sapiens
aacuaaauuuuuuaucagg

SEQ ID NO: 326 - RNA, 19 nt, Homo sapiens
uuuacuaagauuucuuuuc

SEQ ID NO: 327 - RNA, 19 nt, Homo sapiens
aauguuuauacuuugauaa

SEQ ID NO: 328 - RNA, 19 nt, Homo sapiens
accaaauucaguuuguagg

SEQ ID NO: 329 - RNA, 19 nt, Homo sapiens
aaugacauauguuugcucc

SEQ ID NO: 330 - RNA, 19 nt, Homo sapiens
ugaacuacaguuguuacau

SEQ ID NO: 331 - RNA, 19 nt, Homo sapiens
aaauguuccaaugauuucc

SEQ ID NO: 332 - RNA, 19 nt, Homo sapiens
aguaauuucaaaauucuua

SEQ ID NO: 333 - RNA, 19 nt, Homo sapiens
aucgaauucaguugcagaa

SEQ ID NO: 334 - RNA, 19 nt, Homo sapiens
ugaaauacucuuuccaagg

SEQ ID NO: 335 - RNA, 19 nt, Homo sapiens
guaacuaaauuuuuuauca

SEQ ID NO: 336 - RNA, 19 nt, Homo sapiens
uugaaauacucuuuccaag

SEQ ID NO: 337 - RNA, 19 nt, Homo sapiens
aaaucaaguaauuauagug

SEQ ID NO: 338 - RNA, 19 nt, Homo sapiens
aaguaauuauagugaguua

SEQ ID NO: 339 - RNA, 19 nt, Homo sapiens
uuauagugaguuauuuugu

SEQ ID NO: 340 - RNA, 19 nt, Homo sapiens
aaggccaauuuccagagga

SEQ ID NO: 341 - RNA, 19 nt, Homo sapiens
auuauagugaguuauuuug

SEQ ID NO: 342 - RNA, 19 nt, Homo sapiens
ugaaggccaauuuccagag

SEQ ID NO: 343 - RNA, 19 nt, Homo sapiens
uauuauaaaaauaucuugc

SEQ ID NO: 344 - RNA, 19 nt, Homo sapiens
uguacuugacaaaaacauu

SEQ ID NO: 345 - RNA, 19 nt, Homo sapiens
aaagguacuuguuguuuaa

SEQ ID NO: 346 - RNA, 19 nt, Homo sapiens
uccuucacagacuuucuga

SEQ ID NO: 347 - RNA, 19 nt, Homo sapiens
uugcaucaaaugcuucagu

SEQ ID NO: 348 - RNA, 19 nt, Homo sapiens
gacauuuuaacacagaacu

SEQ ID NO: 349 - RNA, 19 nt, Homo sapiens
aaaucaaguaauuauagug

SEQ ID NO: 350 - RNA, 19 nt, Homo sapiens
aaguaauuauagugaguua

SEQ ID NO: 351 - RNA, 19 nt, Homo sapiens
uuauagugaguuauuuugu

SEQ ID NO: 352 - RNA, 19 nt, Homo sapiens
aaggccaauuuccagagga

SEQ ID NO: 353 - RNA, 19 nt, Homo sapiens
auuauagugaguuauuuug

SEQ ID NO: 354 - RNA, 19 nt, Homo sapiens
ugaaggccaauuuccagag

SEQ ID NO: 355 - RNA, 19 nt, Homo sapiens
uauuauaaaaauaucuugc

SEQ ID NO: 356 - RNA, 19 nt, Homo sapiens
uguacuugacaaaaacauu

SEQ ID NO: 357 - RNA, 19 nt, Homo sapiens
aaagguacuuguuguuuaa

SEQ ID NO: 358 - RNA, 19 nt, Homo sapiens
uccuucacagacuuucuga

SEQ ID NO: 359 - RNA, 19 nt, Homo sapiens
uugcaucaaaugcuucagu

SEQ ID NO: 360 - RNA, 19 nt, Homo sapiens
gacauuuuaacacagaacu

SEQ ID NO: 361 - RNA, 19 nt, Homo sapiens
aaaucaaguaauuauagug

SEQ ID NO: 362 - RNA, 19 nt, Homo sapiens
aaguaauuauagugaguua

SEQ ID NO: 363 - RNA, 19 nt, Homo sapiens
uuauagugaguuauuuugu

SEQ ID NO: 364 - RNA, 19 nt, Homo sapiens
aaggccaauuuccagagga

SEQ ID NO: 365 - RNA, 19 nt, Homo sapiens
auuauagugaguuauuuug

SEQ ID NO: 366 - RNA, 19 nt, Homo sapiens
ugaaggccaauuuccagag

SEQ ID NO: 367 - RNA, 19 nt, Homo sapiens
uauuauaaaaauaucuugc

SEQ ID NO: 368 - RNA, 19 nt, Homo sapiens
uguacuugacaaaaacauu

SEQ ID NO: 369 - RNA, 19 nt, Homo sapiens
aaagguacuuguuguuuaa

SEQ ID NO: 370 - RNA, 19 nt, Homo sapiens
uccuucacagacuuucuga

SEQ ID NO: 371 - RNA, 19 nt, Homo sapiens
uugcaucaaaugcuucagu

SEQ ID NO: 372 - RNA, 19 nt, Homo sapiens
gacauuuuaacacagaacu

SEQ ID NO: 373 - RNA, 19 nt, Homo sapiens
aaaucaaguaauuauagug

SEQ ID NO: 374 - RNA, 19 nt, Homo sapiens
aaguaauuauagugaguua

SEQ ID NO: 375 - RNA, 19 nt, Homo sapiens
uuauagugaguuauuuugu

SEQ ID NO: 376 - RNA, 19 nt, Homo sapiens
aaggccaauuuccagagga

SEQ ID NO: 377 - RNA, 19 nt, Homo sapiens
auuauagugaguuauuuug

SEQ ID NO: 378 - RNA, 19 nt, Homo sapiens
ugaaggccaauuuccagag

SEQ ID NO: 379 - RNA, 19 nt, Homo sapiens
uauuauaaaaauaucuugc

SEQ ID NO: 380 - RNA, 19 nt, Homo sapiens
uguacuugacaaaaacauu

SEQ ID NO: 381 - RNA, 19 nt, Homo sapiens
aaagguacuuguuguuuaa

SEQ ID NO: 382 - RNA, 19 nt, Homo sapiens
uccuucacagacuuucuga

SEQ ID NO: 383 - RNA, 19 nt, Homo sapiens
uugcaucaaaugcuucagu

SEQ ID NO: 384 - RNA, 19 nt, Homo sapiens
gacauuuuaacacagaacu

SEQ ID NO: 385 - DNA, 21 bp, Artificial Sequence
  Description of Artificial Sequence: Synthetic oligonucleotide
  Description of Combined DNA/RNA Molecule: Synthetic oligonucleotide
cacuauaauuacuugauuutt

SEQ ID NO: 386 - DNA, 21 bp, Artificial Sequence
  Description of Artificial Sequence: Synthetic oligonucleotide
  Description of Combined DNA/RNA Molecule: Synthetic oligonucleotide
uaacucacuauaauuacuutt

SEQ ID NO: 387 - DNA, 21 bp, Artificial Sequence
  Description of Artificial Sequence: Synthetic oligonucleotide
  Description of Combined DNA/RNA Molecule: Synthetic oligonucleotide
acaaaauaacucacuauaatt

SEQ ID NO: 388 - DNA, 21 bp, Artificial Sequence
  Description of Artificial Sequence: Synthetic oligonucleotide
  Description of Combined DNA/RNA Molecule: Synthetic oligonucleotide
uccucuggaaauuggccuutt

SEQ ID NO: 389 - DNA, 21 bp, Artificial Sequence
  Description of Artificial Sequence: Synthetic oligonucleotide
  Description of Combined DNA/RNA Molecule: Synthetic oligonucleotide
caaaauaacucacuauaautt

SEQ ID NO: 390 - DNA, 21 bp, Artificial Sequence
  Description of Artificial Sequence: Synthetic oligonucleotide
  Description of Combined DNA/RNA Molecule: Synthetic oligonucleotide
cucuggaaauuggccuucatt

SEQ ID NO: 391 - DNA, 21 bp, Artificial Sequence
  Description of Artificial Sequence: Synthetic oligonucleotide
  Description of Combined DNA/RNA Molecule: Synthetic oligonucleotide
gcaagauauuuuuauaauatt

SEQ ID NO: 392 - DNA, 21 bp, Artificial Sequence
  Description of Artificial Sequence: Synthetic oligonucleotide
  Description of Combined DNA/RNA Molecule: Synthetic oligonucleotide
aauguuuuugucaaguacatt

SEQ ID NO: 393 - DNA, 21 bp, Artificial Sequence
  Description of Artificial Sequence: Synthetic oligonucleotide
  Description of Combined DNA/RNA Molecule: Synthetic oligonucleotide
uuaaacaacaaguaccuuutt

SEQ ID NO: 394 - DNA, 21 bp, Artificial Sequence
  Description of Artificial Sequence: Synthetic oligonucleotide
  Description of Combined DNA/RNA Molecule: Synthetic oligonucleotide
ucagaaagucugugaaggatt

SEQ ID NO: 395 - DNA, 21 bp, Artificial Sequence
  Description of Artificial Sequence: Synthetic oligonucleotide
  Description of Combined DNA/RNA Molecule: Synthetic oligonucleotide
acugaagcauuugaugcaatt

SEQ ID NO: 396 - DNA, 21 bp, Artificial Sequence
  Description of Artificial Sequence: Synthetic oligonucleotide
  Description of Combined DNA/RNA Molecule: Synthetic oligonucleotide
aguucuguguuaaaauguctt

SEQ ID NO: 397 - DNA, 21 bp, Artificial Sequence
  Description of Artificial Sequence: Synthetic oligonucleotide
  Description of Combined DNA/RNA Molecule: Synthetic oligonucleotide
gauuuugaguguaaaaggatt

SEQ ID NO: 398 - DNA, 21 bp, Artificial Sequence
  Description of Artificial Sequence: Synthetic oligonucleotide
  Description of Combined DNA/RNA Molecule: Synthetic oligonucleotide
ugaugaaccuuguaaagaatt

SEQ ID NO: 399 - DNA, 21 bp, Artificial Sequence
  Description of Artificial Sequence: Synthetic oligonucleotide
  Description of Combined DNA/RNA Molecule: Synthetic oligonucleotide
cauuggaacauuuuucauutt

SEQ ID NO: 400 - DNA, 21 bp, Artificial Sequence
  Description of Artificial Sequence: Synthetic oligonucleotide
  Description of Combined DNA/RNA Molecule: Synthetic oligonucleotide
ccagaaauucggaguuauutt

SEQ ID NO: 401 - DNA, 21 bp, Artificial Sequence
  Description of Artificial Sequence: Synthetic oligonucleotide
  Description of Combined DNA/RNA Molecule: Synthetic oligonucleotide
ccugggagauaaaacucactt

SEQ ID NO: 402 - DNA, 21 bp, Artificial Sequence
  Description of Artificial Sequence: Synthetic oligonucleotide
  Description of Combined DNA/RNA Molecule: Synthetic oligonucleotide
aaaugaugaaccuuguaaatt

SEQ ID NO: 403 - DNA, 21 bp, Artificial Sequence
  Description of Artificial Sequence: Synthetic oligonucleotide
  Description of Combined DNA/RNA Molecule: Synthetic oligonucleotide
ugcucaagucacauuugautt

SEQ ID NO: 404 - DNA, 21 bp, Artificial Sequence
  Description of Artificial Sequence: Synthetic oligonucleotide
  Description of Combined DNA/RNA Molecule: Synthetic oligonucleotide
gauugcauaugcuuauaaatt

SEQ ID NO: 405 - DNA, 21 bp, Artificial Sequence
  Description of Artificial Sequence: Synthetic oligonucleotide
  Description of Combined DNA/RNA Molecule: Synthetic oligonucleotide
uauccugauaaaaaauuuatt

SEQ ID NO: 406 - DNA, 21 bp, Artificial Sequence
  Description of Artificial Sequence: Synthetic oligonucleotide
  Description of Combined DNA/RNA Molecule: Synthetic oligonucleotide
gaaguuugcagcuuuuauutt

SEQ ID NO: 407 - DNA, 21 bp, Artificial Sequence
  Description of Artificial Sequence: Synthetic oligonucleotide
  Description of Combined DNA/RNA Molecule: Synthetic oligonucleotide
agaaauugaucauauuggatt

SEQ ID NO: 408 - DNA, 21 bp, Artificial Sequence
  Description of Artificial Sequence: Synthetic oligonucleotide
  Description of Combined DNA/RNA Molecule: Synthetic oligonucleotide
ccugauaaaaaauuuaguutt

SEQ ID NO: 409 - DNA, 21 bp, Artificial Sequence
  Description of Artificial Sequence: Synthetic oligonucleotide
  Description of Combined DNA/RNA Molecule: Synthetic oligonucleotide
gaaaagaaaucuuaguaaatt

SEQ ID NO: 410 - DNA, 21 bp, Artificial Sequence
  Description of Artificial Sequence: Synthetic oligonucleotide
  Description of Combined DNA/RNA Molecule: Synthetic oligonucleotide
uuaucaaaguauaaacauutt

SEQ ID NO: 411 - DNA, 21 bp, Artificial Sequence
  Description of Artificial Sequence: Synthetic oligonucleotide
  Description of Combined DNA/RNA Molecule: Synthetic oligonucleotide
ccuacaaacugaauuuggutt

SEQ ID NO: 412 - DNA, 21 bp, Artificial Sequence
  Description of Artificial Sequence: Synthetic oligonucleotide
  Description of Combined DNA/RNA Molecule: Synthetic oligonucleotide
ggagcaaacauaugucauutt

SEQ ID NO: 413 - DNA, 21 bp, Artificial Sequence
  Description of Artificial Sequence: Synthetic oligonucleotide
  Description of Combined DNA/RNA Molecule: Synthetic oligonucleotide
auguaacaacuguaguucatt

SEQ ID NO: 414 - DNA, 21 bp, Artificial Sequence
  Description of Artificial Sequence: Synthetic oligonucleotide
  Description of Combined DNA/RNA Molecule: Synthetic oligonucleotide
ggaaaucauuggaacauuutt

SEQ ID NO: 415 - DNA, 21 bp, Artificial Sequence
  Description of Artificial Sequence: Synthetic oligonucleotide
  Description of Combined DNA/RNA Molecule: Synthetic oligonucleotide
uaagaauuuugaaauuacutt

SEQ ID NO: 416 - DNA, 21 bp, Artificial Sequence
  Description of Artificial Sequence: Synthetic oligonucleotide
  Description of Combined DNA/RNA Molecule: Synthetic oligonucleotide
uucugcaacugaauucgautt

SEQ ID NO: 417 - DNA, 21 bp, Artificial Sequence
  Description of Artificial Sequence: Synthetic oligonucleotide
  Description of Combined DNA/RNA Molecule: Synthetic oligonucleotide
ccuuggaaagaguauuucatt

SEQ ID NO: 418 - DNA, 21 bp, Artificial Sequence
  Description of Artificial Sequence: Synthetic oligonucleotide
  Description of Combined DNA/RNA Molecule: Synthetic oligonucleotide
ugauaaaaaauuuaguuactt

SEQ ID NO: 419 - DNA, 21 bp, Artificial Sequence
  Description of Artificial Sequence: Synthetic oligonucleotide
  Description of Combined DNA/RNA Molecule: Synthetic oligonucleotide
cuuggaaagaguauuucaatt

SEQ ID NO: 420 - DNA, 21 bp, Artificial Sequence
  Description of Artificial Sequence: Synthetic oligonucleotide
  Description of Combined DNA/RNA Molecule: Synthetic oligonucleotide
cacuauaauuacuugauuutt

SEQ ID NO: 421 - DNA, 21 bp, Artificial Sequence
  Description of Artificial Sequence: Synthetic oligonucleotide
  Description of Combined DNA/RNA Molecule: Synthetic oligonucleotide
uaacucacuauaauuacuutt

SEQ ID NO: 422 - DNA, 21 bp, Artificial Sequence
  Description of Artificial Sequence: Synthetic oligonucleotide
  Description of Combined DNA/RNA Molecule: Synthetic oligonucleotide
acaaaauaacucacuauaatt

SEQ ID NO: 423 - DNA, 21 bp, Artificial Sequence
  Description of Artificial Sequence: Synthetic oligonucleotide
  Description of Combined DNA/RNA Molecule: Synthetic oligonucleotide
uccucuggaaauuggccuutt

SEQ ID NO: 424 - DNA, 21 bp, Artificial Sequence
  Description of Artificial Sequence: Synthetic oligonucleotide
  Description of Combined DNA/RNA Molecule: Synthetic oligonucleotide
caaaauaacucacuauaautt

SEQ ID NO: 425 - DNA, 21 bp, Artificial Sequence
  Description of Artificial Sequence: Synthetic oligonucleotide
  Description of Combined DNA/RNA Molecule: Synthetic oligonucleotide
cucuggaaauuggccuucatt

SEQ ID NO: 426 - DNA, 21 bp, Artificial Sequence
  Description of Artificial Sequence: Synthetic oligonucleotide
  Description of Combined DNA/RNA Molecule: Synthetic oligonucleotide
gcaagauauuuuuauaauatt

SEQ ID NO: 427 - DNA, 21 bp, Artificial Sequence
  Description of Artificial Sequence: Synthetic oligonucleotide
  Description of Combined DNA/RNA Molecule: Synthetic oligonucleotide
aauguuuuugucaaguacatt

SEQ ID NO: 428 - DNA, 21 bp, Artificial Sequence
  Description of Artificial Sequence: Synthetic oligonucleotide
  Description of Combined DNA/RNA Molecule: Synthetic oligonucleotide
uuaaacaacaaguaccuuutt

SEQ ID NO: 429 - DNA, 21 bp, Artificial Sequence
  Description of Artificial Sequence: Synthetic oligonucleotide
  Description of Combined DNA/RNA Molecule: Synthetic oligonucleotide
ucagaaagucugugaaggatt

SEQ ID NO: 430 - DNA, 21 bp, Artificial Sequence
  Description of Artificial Sequence: Synthetic oligonucleotide
  Description of Combined DNA/RNA Molecule: Synthetic oligonucleotide
acugaagcauuugaugcaatt

SEQ ID NO: 431 - DNA, 21 bp, Artificial Sequence
  Description of Artificial Sequence: Synthetic oligonucleotide
  Description of Combined DNA/RNA Molecule: Synthetic oligonucleotide
aguucuguguuaaaauguctt

SEQ ID NO: 432 - DNA, 21 bp, Artificial Sequence
  Description of Artificial Sequence: Synthetic oligonucleotide
  Description of Combined DNA/RNA Molecule: Synthetic oligonucleotide
cacuauaauuacuugauuutt

SEQ ID NO: 433 - DNA, 21 bp, Artificial Sequence
  Description of Artificial Sequence: Synthetic oligonucleotide
  Description of Combined DNA/RNA Molecule: Synthetic oligonucleotide
uaacucacuauaauuacuutt

SEQ ID NO: 434 - DNA, 21 bp, Artificial Sequence
  Description of Artificial Sequence: Synthetic oligonucleotide
  Description of Combined DNA/RNA Molecule: Synthetic oligonucleotide
acaaaauaacucacuauaatt

SEQ ID NO: 435 - DNA, 21 bp, Artificial Sequence
  Description of Artificial Sequence: Synthetic oligonucleotide
  Description of Combined DNA/RNA Molecule: Synthetic oligonucleotide
uccucuggaaauuggccuutt

SEQ ID NO: 436 - DNA, 21 bp, Artificial Sequence
  Description of Artificial Sequence: Synthetic oligonucleotide
  Description of Combined DNA/RNA Molecule: Synthetic oligonucleotide
caaaauaacucacuauaautt

SEQ ID NO: 437 - DNA, 21 bp, Artificial Sequence
  Description of Artificial Sequence: Synthetic oligonucleotide
  Description of Combined DNA/RNA Molecule: Synthetic oligonucleotide
cucuggaaauuggccuucatt

SEQ ID NO: 438 - DNA, 21 bp, Artificial Sequence
  Description of Artificial Sequence: Synthetic oligonucleotide
  Description of Combined DNA/RNA Molecule: Synthetic oligonucleotide
gcaagauauuuuuauaauatt

SEQ ID NO: 439 - DNA, 21 bp, Artificial Sequence
  Description of Artificial Sequence: Synthetic oligonucleotide
  Description of Combined DNA/RNA Molecule: Synthetic oligonucleotide
aauguuuuugucaaguacatt

SEQ ID NO: 440 - DNA, 21 bp, Artificial Sequence
  Description of Artificial Sequence: Synthetic oligonucleotide
  Description of Combined DNA/RNA Molecule: Synthetic oligonucleotide
uuaaacaacaaguaccuuutt

SEQ ID NO: 441 - DNA, 21 bp, Artificial Sequence
  Description of Artificial Sequence: Synthetic oligonucleotide
  Description of Combined DNA/RNA Molecule: Synthetic oligonucleotide
ucagaaagucugugaaggatt

SEQ ID NO: 442 - DNA, 21 bp, Artificial Sequence
  Description of Artificial Sequence: Synthetic oligonucleotide
  Description of Combined DNA/RNA Molecule: Synthetic oligonucleotide
acugaagcauuugaugcaatt

SEQ ID NO: 443 - DNA, 21 bp, Artificial Sequence
  Description of Artificial Sequence: Synthetic oligonucleotide
  Description of Combined DNA/RNA Molecule: Synthetic oligonucleotide
aguucuguguuaaaauguctt

SEQ ID NO: 444 - DNA, 21 bp, Artificial Sequence
  Description of Artificial Sequence: Synthetic oligonucleotide
  Description of Combined DNA/RNA Molecule: Synthetic oligonucleotide
cacuauaauuacuugauuutt

SEQ ID NO: 445 - DNA, 21 bp, Artificial Sequence
  Description of Artificial Sequence: Synthetic oligonucleotide
  Description of Combined DNA/RNA Molecule: Synthetic oligonucleotide
uaacucacuauaauuacuutt

SEQ ID NO: 446 - DNA, 21 bp, Artificial Sequence
  Description of Artificial Sequence: Synthetic oligonucleotide
  Description of Combined DNA/RNA Molecule: Synthetic oligonucleotide
acaaaauaacucacuauaatt

SEQ ID NO: 447 - DNA, 21 bp, Artificial Sequence
  Description of Artificial Sequence: Synthetic oligonucleotide
  Description of Combined DNA/RNA Molecule: Synthetic oligonucleotide
uccucuggaaauuggccuutt

SEQ ID NO: 448 - DNA, 21 bp, Artificial Sequence
  Description of Artificial Sequence: Synthetic oligonucleotide
  Description of Combined DNA/RNA Molecule: Synthetic oligonucleotide
caaaauaacucacuauaautt

SEQ ID NO: 449 - DNA, 21 bp, Artificial Sequence
  Description of Artificial Sequence: Synthetic oligonucleotide
  Description of Combined DNA/RNA Molecule: Synthetic oligonucleotide
cucuggaaauuggccuucatt

SEQ ID NO: 450 - DNA, 21 bp, Artificial Sequence
  Description of Artificial Sequence: Synthetic oligonucleotide
  Description of Combined DNA/RNA Molecule: Synthetic oligonucleotide
gcaagauauuuuuauaauatt

SEQ ID NO: 451 - DNA, 21 bp, Artificial Sequence
  Description of Artificial Sequence: Synthetic oligonucleotide
  Description of Combined DNA/RNA Molecule: Synthetic oligonucleotide
aauguuuuugucaaguacatt

SEQ ID NO: 452 - DNA, 21 bp, Artificial Sequence
  Description of Artificial Sequence: Synthetic oligonucleotide
  Description of Combined DNA/RNA Molecule: Synthetic oligonucleotide
uuaaacaacaaguaccuuutt

SEQ ID NO: 453 - DNA, 21 bp, Artificial Sequence
  Description of Artificial Sequence: Synthetic oligonucleotide
  Description of Combined DNA/RNA Molecule: Synthetic oligonucleotide
ucagaaagucugugaaggatt

SEQ ID NO: 454 - DNA, 21 bp, Artificial Sequence
  Description of Artificial Sequence: Synthetic oligonucleotide
  Description of Combined DNA/RNA Molecule: Synthetic oligonucleotide
acugaagcauuugaugcaatt

SEQ ID NO: 455 - DNA, 21 bp, Artificial Sequence
  Description of Artificial Sequence: Synthetic oligonucleotide
  Description of Combined DNA/RNA Molecule: Synthetic oligonucleotide
aguucuguguuaaaauguctt

SEQ ID NO: 456 - DNA, 21 bp, Artificial Sequence
  Description of Artificial Sequence: Synthetic oligonucleotide
  Description of Combined DNA/RNA Molecule: Synthetic oligonucleotide
cacuauaauuacuugauuutt

SEQ ID NO: 457 - DNA, 21 bp, Artificial Sequence
  Description of Artificial Sequence: Synthetic oligonucleotide
  Description of Combined DNA/RNA Molecule: Synthetic oligonucleotide
uaacucacuauaauuacuutt

SEQ ID NO: 458 - DNA, 21 bp, Artificial Sequence
  Description of Artificial Sequence: Synthetic oligonucleotide
  Description of Combined DNA/RNA Molecule: Synthetic oligonucleotide
acaaaauaacucacuauaatt

SEQ ID NO: 459 - DNA, 21 bp, Artificial Sequence
  Description of Artificial Sequence: Synthetic oligonucleotide
  Description of Combined DNA/RNA Molecule: Synthetic oligonucleotide
uccucuggaaauuggccuutt

SEQ ID NO: 460 - DNA, 21 bp, Artificial Sequence
  Description of Artificial Sequence: Synthetic oligonucleotide
  Description of Combined DNA/RNA Molecule: Synthetic oligonucleotide
caaaauaacucacuauaautt

SEQ ID NO: 461 - DNA, 21 bp, Artificial Sequence
  Description of Artificial Sequence: Synthetic oligonucleotide
  Description of Combined DNA/RNA Molecule: Synthetic oligonucleotide
cucuggaaauuggccuucatt

SEQ ID NO: 462 - DNA, 21 bp, Artificial Sequence
  Description of Artificial Sequence: Synthetic oligonucleotide
  Description of Combined DNA/RNA Molecule: Synthetic oligonucleotide
gcaagauauuuuuauaauatt

SEQ ID NO: 463 - DNA, 21 bp, Artificial Sequence
  Description of Artificial Sequence: Synthetic oligonucleotide
  Description of Combined DNA/RNA Molecule: Synthetic oligonucleotide
aauguuuuugucaaguacatt

SEQ ID NO: 464 - DNA, 21 bp, Artificial Sequence
  Description of Artificial Sequence: Synthetic oligonucleotide
  Description of Combined DNA/RNA Molecule: Synthetic oligonucleotide
uuaaacaacaaguaccuuutt

SEQ ID NO: 465 - DNA, 21 bp, Artificial Sequence
  Description of Artificial Sequence: Synthetic oligonucleotide
  Description of Combined DNA/RNA Molecule: Synthetic oligonucleotide
ucagaaagucugugaaggatt

SEQ ID NO: 466 - DNA, 21 bp, Artificial Sequence
  Description of Artificial Sequence: Synthetic oligonucleotide
  Description of Combined DNA/RNA Molecule: Synthetic oligonucleotide
acugaagcauuugaugcaatt

SEQ ID NO: 467 - DNA, 21 bp, Artificial Sequence
  Description of Artificial Sequence: Synthetic oligonucleotide
  Description of Combined DNA/RNA Molecule: Synthetic oligonucleotide
aguucuguguuaaaauguctt

SEQ ID NO: 468 - DNA, 21 bp, Artificial Sequence
  Description of Artificial Sequence: Synthetic oligonucleotide
  Description of Combined DNA/RNA Molecule: Synthetic oligonucleotide
aaaucaaguaauuauagugtt

SEQ ID NO: 469 - DNA, 21 bp, Artificial Sequence
  Description of Artificial Sequence: Synthetic oligonucleotide
  Description of Combined DNA/RNA Molecule: Synthetic oligonucleotide
aaguaauuauagugaguuatt

SEQ ID NO: 470 - DNA, 21 bp, Artificial Sequence
  Description of Artificial Sequence: Synthetic oligonucleotide
  Description of Combined DNA/RNA Molecule: Synthetic oligonucleotide
uuauagugaguuauuuugutt

SEQ ID NO: 471 - DNA, 21 bp, Artificial Sequence
  Description of Artificial Sequence: Synthetic oligonucleotide
  Description of Combined DNA/RNA Molecule: Synthetic oligonucleotide
aaggccaauuuccagaggatt

SEQ ID NO: 472 - DNA, 21 bp, Artificial Sequence
  Description of Artificial Sequence: Synthetic oligonucleotide
  Description of Combined DNA/RNA Molecule: Synthetic oligonucleotide
auuauagugaguuauuuugtt

SEQ ID NO: 473 - DNA, 21 bp, Artificial Sequence
  Description of Artificial Sequence: Synthetic oligonucleotide
  Description of Combined DNA/RNA Molecule: Synthetic oligonucleotide
ugaaggccaauuuccagagtt

SEQ ID NO: 474 - DNA, 21 bp, Artificial Sequence
  Description of Artificial Sequence: Synthetic oligonucleotide
  Description of Combined DNA/RNA Molecule: Synthetic oligonucleotide
uauuauaaaaauaucuugctt

SEQ ID NO: 475 - DNA, 21 bp, Artificial Sequence
  Description of Artificial Sequence: Synthetic oligonucleotide
  Description of Combined DNA/RNA Molecule: Synthetic oligonucleotide
uguacuugacaaaaacauutt

SEQ ID NO: 476 - DNA, 21 bp, Artificial Sequence
  Description of Artificial Sequence: Synthetic oligonucleotide
  Description of Combined DNA/RNA Molecule: Synthetic oligonucleotide
aaagguacuuguuguuuaatt

SEQ ID NO: 477 - DNA, 21 bp, Artificial Sequence
  Description of Artificial Sequence: Synthetic oligonucleotide
  Description of Combined DNA/RNA Molecule: Synthetic oligonucleotide
uccuucacagacuuucugatt

SEQ ID NO: 478 - DNA, 21 bp, Artificial Sequence
  Description of Artificial Sequence: Synthetic oligonucleotide
  Description of Combined DNA/RNA Molecule: Synthetic oligonucleotide
uugcaucaaaugcuucagutt

SEQ ID NO: 479 - DNA, 21 bp, Artificial Sequence
  Description of Artificial Sequence: Synthetic oligonucleotide
  Description of Combined DNA/RNA Molecule: Synthetic oligonucleotide
gacauuuuaacacagaacutt

SEQ ID NO: 480 - DNA, 21 bp, Artificial Sequence
  Description of Artificial Sequence: Synthetic oligonucleotide
  Description of Combined DNA/RNA Molecule: Synthetic oligonucleotide
uccuuuuacacucaaaauctt

SEQ ID NO: 481 - DNA, 21 bp, Artificial Sequence
  Description of Artificial Sequence: Synthetic oligonucleotide
  Description of Combined DNA/RNA Molecule: Synthetic oligonucleotide
uucuuuacaagguucaucatt

SEQ ID NO: 482 - DNA, 21 bp, Artificial Sequence
  Description of Artificial Sequence: Synthetic oligonucleotide
  Description of Combined DNA/RNA Molecule: Synthetic oligonucleotide
aaugaaaaauguuccaaugtt

SEQ ID NO: 483 - DNA, 21 bp, Artificial Sequence
  Description of Artificial Sequence: Synthetic oligonucleotide
  Description of Combined DNA/RNA Molecule: Synthetic oligonucleotide
aauaacuccgaauuucuggtt

SEQ ID NO: 484 - DNA, 21 bp, Artificial Sequence
  Description of Artificial Sequence: Synthetic oligonucleotide
  Description of Combined DNA/RNA Molecule: Synthetic oligonucleotide
gugaguuuuaucucccaggtt

SEQ ID NO: 485 - DNA, 21 bp, Artificial Sequence
  Description of Artificial Sequence: Synthetic oligonucleotide
  Description of Combined DNA/RNA Molecule: Synthetic oligonucleotide
uuuacaagguucaucauuutt

SEQ ID NO: 486 - DNA, 21 bp, Artificial Sequence
  Description of Artificial Sequence: Synthetic oligonucleotide
  Description of Combined DNA/RNA Molecule: Synthetic oligonucleotide
aucaaaugugacuugagcatt

SEQ ID NO: 487 - DNA, 21 bp, Artificial Sequence
  Description of Artificial Sequence: Synthetic oligonucleotide
  Description of Combined DNA/RNA Molecule: Synthetic oligonucleotide
uuuauaagcauaugcaauctt

SEQ ID NO: 488 - DNA, 21 bp, Artificial Sequence
  Description of Artificial Sequence: Synthetic oligonucleotide
  Description of Combined DNA/RNA Molecule: Synthetic oligonucleotide
uaaauuuuuuaucaggauatt

SEQ ID NO: 489 - DNA, 21 bp, Artificial Sequence
  Description of Artificial Sequence: Synthetic oligonucleotide
  Description of Combined DNA/RNA Molecule: Synthetic oligonucleotide
aauaaaagcugcaaacuuctt

SEQ ID NO: 490 - DNA, 21 bp, Artificial Sequence
  Description of Artificial Sequence: Synthetic oligonucleotide
  Description of Combined DNA/RNA Molecule: Synthetic oligonucleotide
uccaauaugaucaauuucutt

SEQ ID NO: 491 - DNA, 21 bp, Artificial Sequence
  Description of Artificial Sequence: Synthetic oligonucleotide
  Description of Combined DNA/RNA Molecule: Synthetic oligonucleotide
aacuaaauuuuuuaucaggtt

SEQ ID NO: 492 - DNA, 21 bp, Artificial Sequence
  Description of Artificial Sequence: Synthetic oligonucleotide
  Description of Combined DNA/RNA Molecule: Synthetic oligonucleotide
uuuacuaagauuucuuuuctt

SEQ ID NO: 493 - DNA, 21 bp, Artificial Sequence
  Description of Artificial Sequence: Synthetic oligonucleotide
  Description of Combined DNA/RNA Molecule: Synthetic oligonucleotide
aauguuuauacuuugauaatt

SEQ ID NO: 494 - DNA, 21 bp, Artificial Sequence
  Description of Artificial Sequence: Synthetic oligonucleotide
  Description of Combined DNA/RNA Molecule: Synthetic oligonucleotide
accaaauucaguuuguaggtt

SEQ ID NO: 495 - DNA, 21 bp, Artificial Sequence
  Description of Artificial Sequence: Synthetic oligonucleotide
  Description of Combined DNA/RNA Molecule: Synthetic oligonucleotide
aaugacauauguuugcucctt

SEQ ID NO: 496 - DNA, 21 bp, Artificial Sequence
  Description of Artificial Sequence: Synthetic oligonucleotide
  Description of Combined DNA/RNA Molecule: Synthetic oligonucleotide
ugaacuacaguuguuacautt

SEQ ID NO: 497 - DNA, 21 bp, Artificial Sequence
  Description of Artificial Sequence: Synthetic oligonucleotide
  Description of Combined DNA/RNA Molecule: Synthetic oligonucleotide
aaauguuccaaugauuucctt

SEQ ID NO: 498 - DNA, 21 bp, Artificial Sequence
  Description of Artificial Sequence: Synthetic oligonucleotide
  Description of Combined DNA/RNA Molecule: Synthetic oligonucleotide
aguaauuucaaaauucuuatt

SEQ ID NO: 499 - DNA, 21 bp, Artificial Sequence
  Description of Artificial Sequence: Synthetic oligonucleotide
  Description of Combined DNA/RNA Molecule: Synthetic oligonucleotide
aucgaauucaguugcagaatt

SEQ ID NO: 500 - DNA, 21 bp, Artificial Sequence
  Description of Artificial Sequence: Synthetic oligonucleotide
  Description of Combined DNA/RNA Molecule: Synthetic oligonucleotide
ugaaauacucuuuccaaggtt

SEQ ID NO: 501 - DNA, 21 bp, Artificial Sequence
  Description of Artificial Sequence: Synthetic oligonucleotide
  Description of Combined DNA/RNA Molecule: Synthetic oligonucleotide
guaacuaaauuuuuuaucatt

SEQ ID NO: 502 - DNA, 21 bp, Artificial Sequence
  Description of Artificial Sequence: Synthetic oligonucleotide
  Description of Combined DNA/RNA Molecule: Synthetic oligonucleotide
uugaaauacucuuuccaagtt

SEQ ID NO: 503 - DNA, 21 bp, Artificial Sequence
  Description of Artificial Sequence: Synthetic oligonucleotide
  Description of Combined DNA/RNA Molecule: Synthetic oligonucleotide
aaaucaaguaauuauagugtt

SEQ ID NO: 504 - DNA, 21 bp, Artificial Sequence
  Description of Artificial Sequence: Synthetic oligonucleotide
  Description of Combined DNA/RNA Molecule: Synthetic oligonucleotide
aaguaauuauagugaguuatt

SEQ ID NO: 505 - DNA, 21 bp, Artificial Sequence
  Description of Artificial Sequence: Synthetic oligonucleotide
  Description of Combined DNA/RNA Molecule: Synthetic oligonucleotide
uuauagugaguuauuuugutt

SEQ ID NO: 506 - DNA, 21 bp, Artificial Sequence
  Description of Artificial Sequence: Synthetic oligonucleotide
  Description of Combined DNA/RNA Molecule: Synthetic oligonucleotide
aaggccaauuuccagaggatt

SEQ ID NO: 507 - DNA, 21 bp, Artificial Sequence
  Description of Artificial Sequence: Synthetic oligonucleotide
  Description of Combined DNA/RNA Molecule: Synthetic oligonucleotide
auuauagugaguuauuuugtt

SEQ ID NO: 508 - DNA, 21 bp, Artificial Sequence
  Description of Artificial Sequence: Synthetic oligonucleotide
  Description of Combined DNA/RNA Molecule: Synthetic oligonucleotide
ugaaggccaauuuccagagtt

SEQ ID NO: 509 - DNA, 21 bp, Artificial Sequence
  Description of Artificial Sequence: Synthetic oligonucleotide
  Description of Combined DNA/RNA Molecule: Synthetic oligonucleotide
uauuauaaaaauaucuugctt

SEQ ID NO: 510 - DNA, 21 bp, Artificial Sequence
  Description of Artificial Sequence: Synthetic oligonucleotide
  Description of Combined DNA/RNA Molecule: Synthetic oligonucleotide
uguacuugacaaaaacauutt

SEQ ID NO: 511 - DNA, 21 bp, Artificial Sequence
  Description of Artificial Sequence: Synthetic oligonucleotide
  Description of Combined DNA/RNA Molecule: Synthetic oligonucleotide
aaagguacuuguuguuuaatt

SEQ ID NO: 512 - DNA, 21 bp, Artificial Sequence
  Description of Artificial Sequence: Synthetic oligonucleotide
  Description of Combined DNA/RNA Molecule: Synthetic oligonucleotide
uccuucacagacuuucugatt

SEQ ID NO: 513 - DNA, 21 bp, Artificial Sequence
  Description of Artificial Sequence: Synthetic oligonucleotide
  Description of Combined DNA/RNA Molecule: Synthetic oligonucleotide
uugcaucaaaugcuucagutt

SEQ ID NO: 514 - DNA, 21 bp, Artificial Sequence
  Description of Artificial Sequence: Synthetic oligonucleotide
  Description of Combined DNA/RNA Molecule: Synthetic oligonucleotide
gacauuuuaacacagaacutt

SEQ ID NO: 515 - DNA, 21 bp, Artificial Sequence
  Description of Artificial Sequence: Synthetic oligonucleotide
  Description of Combined DNA/RNA Molecule: Synthetic oligonucleotide
aaaucaaguaauuauagugtt

SEQ ID NO: 516 - DNA, 21 bp, Artificial Sequence
  Description of Artificial Sequence: Synthetic oligonucleotide
  Description of Combined DNA/RNA Molecule: Synthetic oligonucleotide
aaguaauuauagugaguuatt

SEQ ID NO: 517 - DNA, 21 bp, Artificial Sequence
  Description of Artificial Sequence: Synthetic oligonucleotide
  Description of Combined DNA/RNA Molecule: Synthetic oligonucleotide
uuauagugaguuauuuugutt

SEQ ID NO: 518 - DNA, 21 bp, Artificial Sequence
  Description of Artificial Sequence: Synthetic oligonucleotide
  Description of Combined DNA/RNA Molecule: Synthetic oligonucleotide
aaggccaauuuccagaggatt

SEQ ID NO: 519 - DNA, 21 bp, Artificial Sequence
  Description of Artificial Sequence: Synthetic oligonucleotide
  Description of Combined DNA/RNA Molecule: Synthetic oligonucleotide
auuauagugaguuauuuugtt

SEQ ID NO: 520 - DNA, 21 bp, Artificial Sequence
  Description of Artificial Sequence: Synthetic oligonucleotide
  Description of Combined DNA/RNA Molecule: Synthetic oligonucleotide
ugaaggccaauuuccagagtt

SEQ ID NO: 521 - DNA, 21 bp, Artificial Sequence
  Description of Artificial Sequence: Synthetic oligonucleotide
  Description of Combined DNA/RNA Molecule: Synthetic oligonucleotide
uauuauaaaaauaucuugctt

SEQ ID NO: 522 - DNA, 21 bp, Artificial Sequence
  Description of Artificial Sequence: Synthetic oligonucleotide
  Description of Combined DNA/RNA Molecule: Synthetic oligonucleotide
uguacuugacaaaaacauutt

SEQ ID NO: 523 - DNA, 21 bp, Artificial Sequence
  Description of Artificial Sequence: Synthetic oligonucleotide
  Description of Combined DNA/RNA Molecule: Synthetic oligonucleotide
aaagguacuuguuguuuaatt

SEQ ID NO: 524 - DNA, 21 bp, Artificial Sequence
  Description of Artificial Sequence: Synthetic oligonucleotide
  Description of Combined DNA/RNA Molecule: Synthetic oligonucleotide
uccuucacagacuuucugatt

SEQ ID NO: 525 - DNA, 21 bp, Artificial Sequence
  Description of Artificial Sequence: Synthetic oligonucleotide
  Description of Combined DNA/RNA Molecule: Synthetic oligonucleotide
uugcaucaaaugcuucagutt

SEQ ID NO: 526 - DNA, 21 bp, Artificial Sequence
  Description of Artificial Sequence: Synthetic oligonucleotide
  Description of Combined DNA/RNA Molecule: Synthetic oligonucleotide
gacauuuuaacacagaacutt

SEQ ID NO: 527 - DNA, 21 bp, Artificial Sequence
  Description of Artificial Sequence: Synthetic oligonucleotide
  Description of Combined DNA/RNA Molecule: Synthetic oligonucleotide
aaaucaaguaauuauagugtt

SEQ ID NO: 528 - DNA, 21 bp, Artificial Sequence
  Description of Artificial Sequence: Synthetic oligonucleotide
  Description of Combined DNA/RNA Molecule: Synthetic oligonucleotide
aaguaauuauagugaguuatt

SEQ ID NO: 529 - DNA, 21 bp, Artificial Sequence
  Description of Artificial Sequence: Synthetic oligonucleotide
  Description of Combined DNA/RNA Molecule: Synthetic oligonucleotide
uuauagugaguuauuuugutt

SEQ ID NO: 530 - DNA, 21 bp, Artificial Sequence
  Description of Artificial Sequence: Synthetic oligonucleotide
  Description of Combined DNA/RNA Molecule: Synthetic oligonucleotide
aaggccaauuuccagaggatt

SEQ ID NO: 531 - DNA, 21 bp, Artificial Sequence
  Description of Artificial Sequence: Synthetic oligonucleotide
  Description of Combined DNA/RNA Molecule: Synthetic oligonucleotide
auuauagugaguuauuuugtt

SEQ ID NO: 532 - DNA, 21 bp, Artificial Sequence
  Description of Artificial Sequence: Synthetic oligonucleotide
  Description of Combined DNA/RNA Molecule: Synthetic oligonucleotide
ugaaggccaauuuccagagtt

SEQ ID NO: 533 - DNA, 21 bp, Artificial Sequence
  Description of Artificial Sequence: Synthetic oligonucleotide
  Description of Combined DNA/RNA Molecule: Synthetic oligonucleotide
uauuauaaaaauaucuugctt

SEQ ID NO: 534 - DNA, 21 bp, Artificial Sequence
  Description of Artificial Sequence: Synthetic oligonucleotide
  Description of Combined DNA/RNA Molecule: Synthetic oligonucleotide
uguacuugacaaaaacauutt

SEQ ID NO: 535 - DNA, 21 bp, Artificial Sequence
  Description of Artificial Sequence: Synthetic oligonucleotide
  Description of Combined DNA/RNA Molecule: Synthetic oligonucleotide
aaagguacuuguuguuuaatt

SEQ ID NO: 536 - DNA, 21 bp, Artificial Sequence
  Description of Artificial Sequence: Synthetic oligonucleotide
  Description of Combined DNA/RNA Molecule: Synthetic oligonucleotide
uccuucacagacuuucugatt

SEQ ID NO: 537 - DNA, 21 bp, Artificial Sequence
  Description of Artificial Sequence: Synthetic oligonucleotide
  Description of Combined DNA/RNA Molecule: Synthetic oligonucleotide
uugcaucaaaugcuucagutt

SEQ ID NO: 538 - DNA, 21 bp, Artificial Sequence
  Description of Artificial Sequence: Synthetic oligonucleotide
  Description of Combined DNA/RNA Molecule: Synthetic oligonucleotide
gacauuuuaacacagaacutt

SEQ ID NO: 539 - DNA, 21 bp, Artificial Sequence
  Description of Artificial Sequence: Synthetic oligonucleotide
  Description of Combined DNA/RNA Molecule: Synthetic oligonucleotide
aaaucaaguaauuauagugtt

SEQ ID NO: 540 - DNA, 21 bp, Artificial Sequence
  Description of Artificial Sequence: Synthetic oligonucleotide
  Description of Combined DNA/RNA Molecule: Synthetic oligonucleotide
aaguaauuauagugaguuatt

SEQ ID NO: 541 - DNA, 21 bp, Artificial Sequence
  Description of Artificial Sequence: Synthetic oligonucleotide
  Description of Combined DNA/RNA Molecule: Synthetic oligonucleotide
uuauagugaguuauuuugutt

SEQ ID NO: 542 - DNA, 21 bp, Artificial Sequence
  Description of Artificial Sequence: Synthetic oligonucleotide
  Description of Combined DNA/RNA Molecule: Synthetic oligonucleotide
aaggccaauuuccagaggatt

SEQ ID NO: 543 - DNA, 21 bp, Artificial Sequence
  Description of Artificial Sequence: Synthetic oligonucleotide
  Description of Combined DNA/RNA Molecule: Synthetic oligonucleotide
auuauagugaguuauuuugtt

SEQ ID NO: 544 - DNA, 21 bp, Artificial Sequence
  Description of Artificial Sequence: Synthetic oligonucleotide
  Description of Combined DNA/RNA Molecule: Synthetic oligonucleotide
ugaaggccaauuuccagagtt

SEQ ID NO: 545 - DNA, 21 bp, Artificial Sequence
  Description of Artificial Sequence: Synthetic oligonucleotide
  Description of Combined DNA/RNA Molecule: Synthetic oligonucleotide
uauuauaaaaauaucuugctt

SEQ ID NO: 546 - DNA, 21 bp, Artificial Sequence
  Description of Artificial Sequence: Synthetic oligonucleotide
  Description of Combined DNA/RNA Molecule: Synthetic oligonucleotide
uguacuugacaaaaacauutt

SEQ ID NO: 547 - DNA, 21 bp, Artificial Sequence
  Description of Artificial Sequence: Synthetic oligonucleotide
  Description of Combined DNA/RNA Molecule: Synthetic oligonucleotide
aaagguacuuguuguuuaatt

SEQ ID NO: 548 - DNA, 21 bp, Artificial Sequence
  Description of Artificial Sequence: Synthetic oligonucleotide
  Description of Combined DNA/RNA Molecule: Synthetic oligonucleotide
uccuucacagacuuucugatt

SEQ ID NO: 549 - DNA, 21 bp, Artificial Sequence
  Description of Artificial Sequence: Synthetic oligonucleotide
  Description of Combined DNA/RNA Molecule: Synthetic oligonucleotide
uugcaucaaaugcuucagutt

SEQ ID NO: 550 - DNA, 21 bp, Artificial Sequence
  Description of Artificial Sequence: Synthetic oligonucleotide
  Description of Combined DNA/RNA Molecule: Synthetic oligonucleotide
gacauuuuaacacagaacutt

SEQ ID NO: 551 - RNA, 21 nt, Artificial Sequence
  Description of Artificial Sequence: Synthetic oligonucleotide
gacaaaauaacucacuauaau

SEQ ID NO: 552 - RNA, 21 nt, Artificial Sequence
  Description of Artificial Sequence: Synthetic oligonucleotide
gacaaaauaacucacuauaau

SEQ ID NO: 553 - RNA, 21 nt, Artificial Sequence
  Description of Artificial Sequence: Synthetic oligonucleotide
cagaucaaacacaauuucagu

SEQ ID NO: 554 - RNA, 21 nt, Artificial Sequence
  Description of Artificial Sequence: Synthetic oligonucleotide
cagaucaaacacaauuucagu

SEQ ID NO: 555 - RNA, 23 nt, Artificial Sequence
  Description of Artificial Sequence: Synthetic oligonucleotide
auuauagugaguuauuuugucaa

SEQ ID NO: 556 - RNA, 23 nt, Artificial Sequence
  Description of Artificial Sequence: Synthetic oligonucleotide
auuauagugaguuauuuugucaa

SEQ ID NO: 557 - RNA, 23 nt, Artificial Sequence
  Description of Artificial Sequence: Synthetic oligonucleotide
acugaaauuguguuugaucugca

SEQ ID NO: 558 - RNA, 23 nt, Artificial Sequence
  Description of Artificial Sequence: Synthetic oligonucleotide
acugaaauuguguuugaucugca

SEQ ID NO: 559 - RNA, 21 nt, Artificial Sequence
  Description of Artificial Sequence: Synthetic oligonucleotide
auuuaaacaacaaguaccuuu

SEQ ID NO: 560 - RNA, 21 nt, Artificial Sequence
  Description of Artificial Sequence: Synthetic oligonucleotide
auuuaaacaacaaguaccuuu

SEQ ID NO: 561 - RNA, 21 nt, Artificial Sequence
  Description of Artificial Sequence: Synthetic oligonucleotide
auuuaaacaacaaguaccuuu

SEQ ID NO: 562 - RNA, 21 nt, Artificial Sequence
  Description of Artificial Sequence: Synthetic oligonucleotide
ugacaaaauaacucacuauaa

SEQ ID NO: 563 - RNA, 21 nt, Artificial Sequence
  Description of Artificial Sequence: Synthetic oligonucleotide
ugacaaaauaacucacuauaa

SEQ ID NO: 564 - RNA, 21 nt, Artificial Sequence
  Description of Artificial Sequence: Synthetic oligonucleotide
ugacaaaauaacucacuauaa

SEQ ID NO: 565 - RNA, 21 nt, Artificial Sequence
  Description of Artificial Sequence: Synthetic oligonucleotide
gacaaaauaacucacuauaau

SEQ ID NO: 566 - RNA, 21 nt, Artificial Sequence
  Description of Artificial Sequence: Synthetic oligonucleotide
gacaaaauaacucacuauaau

SEQ ID NO: 567 - RNA, 21 nt, Artificial Sequence
  Description of Artificial Sequence: Synthetic oligonucleotide
gacaaaauaacucacuauaau

SEQ ID NO: 568 - RNA, 21 nt, Artificial Sequence
  Description of Artificial Sequence: Synthetic oligonucleotide
guuccggauauuugaacuuuu

SEQ ID NO: 569 - RNA, 21 nt, Artificial Sequence
  Description of Artificial Sequence: Synthetic oligonucleotide
guuccggauauuugaacuuuu

SEQ ID NO: 570 - RNA, 21 nt, Artificial Sequence
  Description of Artificial Sequence: Synthetic oligonucleotide
guuccggauauuugaacuuuu

SEQ ID NO: 571 - RNA, 21 nt, Artificial Sequence
  Description of Artificial Sequence: Synthetic oligonucleotide
ugcagaucaaacacaauuuca

SEQ ID NO: 572 - RNA, 21 nt, Artificial Sequence
  Description of Artificial Sequence: Synthetic oligonucleotide
ugcagaucaaacacaauuuca

SEQ ID NO: 573 - RNA, 21 nt, Artificial Sequence
  Description of Artificial Sequence: Synthetic oligonucleotide
ugcagaucaaacacaauuuca

SEQ ID NO: 574 - RNA, 21 nt, Artificial Sequence
  Description of Artificial Sequence: Synthetic oligonucleotide
aagcaagauauuuuuauaaua

SEQ ID NO: 575 - RNA, 21 nt, Artificial Sequence
  Description of Artificial Sequence: Synthetic oligonucleotide
aagcaagauauuuuuauaaua

SEQ ID NO: 576 - RNA, 21 nt, Artificial Sequence
  Description of Artificial Sequence: Synthetic oligonucleotide
aagcaagauauuuuuauaaua

SEQ ID NO: 577 - RNA, 21 nt, Artificial Sequence
  Description of Artificial Sequence: Synthetic oligonucleotide
cagaucaaacacaauuucagu

SEQ ID NO: 578 - RNA, 21 nt, Artificial Sequence
  Description of Artificial Sequence: Synthetic oligonucleotide
cagaucaaacacaauuucagu

SEQ ID NO: 579 - RNA, 21 nt, Artificial Sequence
  Description of Artificial Sequence: Synthetic oligonucleotide
cagaucaaacacaauuucagu

SEQ ID NO: 580 - RNA, 23 nt, Artificial Sequence
  Description of Artificial Sequence: Synthetic oligonucleotide
aaagguacuuguuguuuaaaucu

SEQ ID NO: 581 - RNA, 23 nt, Artificial Sequence
  Description of Artificial Sequence: Synthetic oligonucleotide
aaagguacuuguuguuuaaaucu

SEQ ID NO: 582 - RNA, 23 nt, Artificial Sequence
  Description of Artificial Sequence: Synthetic oligonucleotide
aaagguacuuguuguuuaaaucu

SEQ ID NO: 583 - RNA, 23 nt, Artificial Sequence
  Description of Artificial Sequence: Synthetic oligonucleotide
uuauagugaguuauuuugucaau

SEQ ID NO: 584 - RNA, 23 nt, Artificial Sequence
  Description of Artificial Sequence: Synthetic oligonucleotide
uuauagugaguuauuuugucaau

SEQ ID NO: 585 - RNA, 23 nt, Artificial Sequence
  Description of Artificial Sequence: Synthetic oligonucleotide
uuauagugaguuauuuugucaau

SEQ ID NO: 586 - RNA, 23 nt, Artificial Sequence
  Description of Artificial Sequence: Synthetic oligonucleotide
auuauagugaguuauuuugucaa

SEQ ID NO: 587 - RNA, 23 nt, Artificial Sequence
  Description of Artificial Sequence: Synthetic oligonucleotide
auuauagugaguuauuuugucaa

SEQ ID NO: 588 - RNA, 23 nt, Artificial Sequence
  Description of Artificial Sequence: Synthetic oligonucleotide
auuauagugaguuauuuugucaa

SEQ ID NO: 589 - RNA, 23 nt, Artificial Sequence
  Description of Artificial Sequence: Synthetic oligonucleotide
aaaaguucaaauauccggaaccg

SEQ ID NO: 590 - RNA, 23 nt, Artificial Sequence
  Description of Artificial Sequence: Synthetic oligonucleotide
aaaaguucaaauauccggaaccg

SEQ ID NO: 591 - RNA, 23 nt, Artificial Sequence
  Description of Artificial Sequence: Synthetic oligonucleotide
aaaaguucaaauauccggaaccg

SEQ ID NO: 592 - RNA, 23 nt, Artificial Sequence
  Description of Artificial Sequence: Synthetic oligonucleotide
ugaaauuguguuugaucugcaga

SEQ ID NO: 593 - RNA, 23 nt, Artificial Sequence
  Description of Artificial Sequence: Synthetic oligonucleotide
ugaaauuguguuugaucugcaga

SEQ ID NO: 594 - RNA, 23 nt, Artificial Sequence
  Description of Artificial Sequence: Synthetic oligonucleotide
ugaaauuguguuugaucugcaga

SEQ ID NO: 595 - RNA, 23 nt, Artificial Sequence
  Description of Artificial Sequence: Synthetic oligonucleotide
uauuauaaaaauaucuugcuuuu

SEQ ID NO: 596 - RNA, 23 nt, Artificial Sequence
  Description of Artificial Sequence: Synthetic oligonucleotide
uauuauaaaaauaucuugcuuuu

SEQ ID NO: 597 - RNA, 23 nt, Artificial Sequence
  Description of Artificial Sequence: Synthetic oligonucleotide
uauuauaaaaauaucuugcuuuu

SEQ ID NO: 598 - RNA, 23 nt, Artificial Sequence
  Description of Artificial Sequence: Synthetic oligonucleotide
acugaaauuguguuugaucugca

SEQ ID NO: 599 - RNA, 23 nt, Artificial Sequence
  Description of Artificial Sequence: Synthetic oligonucleotide
acugaaauuguguuugaucugca

SEQ ID NO: 600 - RNA, 23 nt, Artificial Sequence
  Description of Artificial Sequence: Synthetic oligonucleotide
acugaaauuguguuugaucugca

SEQ ID NO: 601 - RNA, 19 nt, Homo sapiens
uauccgugguuuccugcua

SEQ ID NO: 602 - RNA, 19 nt, Homo sapiens
gguuuccugcuaccuccaa

SEQ ID NO: 603 - RNA, 19 nt, Homo sapiens
ccuccaaccaugggccuuu

SEQ ID NO: 604 - RNA, 19 nt, Homo sapiens
gggccuuuugggaauacuu

SEQ ID NO: 605 - RNA, 19 nt, Homo sapiens
ggaauacuuuguuuuuuaa

SEQ ID NO: 606 - RNA, 19 nt, Homo sapiens
cuuuguuuuuuaaucuucc

SEQ ID NO: 607 - RNA, 19 nt, Homo sapiens
cuuccuggggaaaaccugg

SEQ ID NO: 608 - RNA, 19 nt, Homo sapiens
ggaaaaccuggggacagga

SEQ ID NO: 609 - RNA, 19 nt, Homo sapiens
gggacaggagcaaacauau

SEQ ID NO: 610 - RNA, 19 nt, Homo sapiens
caaacauaugucauuucag

SEQ ID NO: 611 - RNA, 19 nt, Homo sapiens
cauuucagcaccaaaaaua

SEQ ID NO: 612 - RNA, 19 nt, Homo sapiens
gcaccaaaaauauuccgug

SEQ ID NO: 613 - RNA, 19 nt, Homo sapiens
ccguguuggagcaucugaa

SEQ ID NO: 614 - RNA, 19 nt, Homo sapiens
ggagcaucugaaaauauug

SEQ ID NO: 615 - RNA, 19 nt, Homo sapiens
gaaaauauugugauucaag

SEQ ID NO: 616 - RNA, 19 nt, Homo sapiens
gauucaaguuuauggauac

SEQ ID NO: 617 - RNA, 19 nt, Homo sapiens
ggauacacugaagcauuug

SEQ ID NO: 618 - RNA, 19 nt, Homo sapiens
gaagcauuugaugcaacaa

SEQ ID NO: 619 - RNA, 19 nt, Homo sapiens
ugcaacaaucucuauuaaa

SEQ ID NO: 620 - RNA, 19 nt, Homo sapiens
aaucucuauuaaaaguuau

SEQ ID NO: 621 - RNA, 19 nt, Homo sapiens
aaguuauccugauaaaaaa

SEQ ID NO: 622 - RNA, 19 nt, Homo sapiens
cugauaaaaaauuuaguua

SEQ ID NO: 623 - RNA, 19 nt, Homo sapiens
uuaguuacuccucaggcca

SEQ ID NO: 624 - RNA, 19 nt, Homo sapiens
ccucaggccauguucauuu

SEQ ID NO: 625 - RNA, 19 nt, Homo sapiens
uucauuuauccucagagaa

SEQ ID NO: 626 - RNA, 19 nt, Homo sapiens
cucagagaauaaauuccaa

SEQ ID NO: 627 - RNA, 19 nt, Homo sapiens
aauaaauuccaaaacucug

SEQ ID NO: 628 - RNA, 19 nt, Homo sapiens
cucugcaaucuuaacaaua

SEQ ID NO: 629 - RNA, 19 nt, Homo sapiens
cuuaacaauacaaccaaaa

SEQ ID NO: 630 - RNA, 19 nt, Homo sapiens
caaccaaaacaauugccug

SEQ ID NO: 631 - RNA, 19 nt, Homo sapiens
caauugccuggaggacaaa

SEQ ID NO: 632 - RNA, 19 nt, Homo sapiens
ggacaaaacccaguuucuu

SEQ ID NO: 633 - RNA, 19 nt, Homo sapiens
ccaguuucuuauguguauu

SEQ ID NO: 634 - RNA, 19 nt, Homo sapiens
auguguauuuggaaguugu

SEQ ID NO: 635 - RNA, 19 nt, Homo sapiens
ggaaguuguaucaaagcau

SEQ ID NO: 636 - RNA, 19 nt, Homo sapiens
guaucaaagcauuuuucaa

SEQ ID NO: 637 - RNA, 19 nt, Homo sapiens
uuuucaaaaucaaaaagaa

SEQ ID NO: 638 - RNA, 19 nt, Homo sapiens
caaaaagaaugccaauaac

SEQ ID NO: 639 - RNA, 19 nt, Homo sapiens
gccaauaaccuaugacaau

SEQ ID NO: 640 - RNA, 19 nt, Homo sapiens
ccuaugacaauggauuucu

SEQ ID NO: 641 - RNA, 19 nt, Homo sapiens
uggauuucucuucauucau

SEQ ID NO: 642 - RNA, 19 nt, Homo sapiens
cauucauacagacaaaccu

SEQ ID NO: 643 - RNA, 19 nt, Homo sapiens
cagacaaaccuguuuauac

SEQ ID NO: 644 - RNA, 19 nt, Homo sapiens
guuuauacuccagaccagu

SEQ ID NO: 645 - RNA, 19 nt, Homo sapiens
agaccagucaguaaaaguu

SEQ ID NO: 646 - RNA, 19 nt, Homo sapiens
aguaaaaguuagaguuuau

SEQ ID NO: 647 - RNA, 19 nt, Homo sapiens
agaguuuauucguugaaug

SEQ ID NO: 648 - RNA, 19 nt, Homo sapiens
cguugaaugacgacuugaa

SEQ ID NO: 649 - RNA, 19 nt, Homo sapiens
cuugaagccagccaaaaga

SEQ ID NO: 650 - RNA, 19 nt, Homo sapiens
ccagccaaaagagaaacug

SEQ ID NO: 651 - RNA, 19 nt, Homo sapiens
aaacugucuuaacuuucau

SEQ ID NO: 652 - RNA, 19 nt, Homo sapiens
aacuuucauagauccugaa

SEQ ID NO: 653 - RNA, 19 nt, Homo sapiens
cauagauccugaaggauca

SEQ ID NO: 654 - RNA, 19 nt, Homo sapiens
gaaggaucagaaguugaca

SEQ ID NO: 655 - RNA, 19 nt, Homo sapiens
ugacaugguagaagaaauu

SEQ ID NO: 656 - RNA, 19 nt, Homo sapiens
gaagaaauugaucauauug

SEQ ID NO: 657 - RNA, 19 nt, Homo sapiens
gaucauauuggaauuaucu

SEQ ID NO: 658 - RNA, 19 nt, Homo sapiens
ggaauuaucucuuuuccug

SEQ ID NO: 659 - RNA, 19 nt, Homo sapiens
cucuuuuccugacuucaag

SEQ ID NO: 660 - RNA, 19 nt, Homo sapiens
acuucaagauuccgucuaa

SEQ ID NO: 661 - RNA, 19 nt, Homo sapiens
ccgucuaauccuagauaug

SEQ ID NO: 662 - RNA, 19 nt, Homo sapiens
ccuagauaugguaugugga

SEQ ID NO: 663 - RNA, 19 nt, Homo sapiens
uguggacgaucaaggcuaa

SEQ ID NO: 664 - RNA, 19 nt, Homo sapiens
cgaucaaggcuaaauauaa

SEQ ID NO: 665 - RNA, 19 nt, Homo sapiens
auauaaagaggacuuuuca

SEQ ID NO: 666 - RNA, 19 nt, Homo sapiens
gaggacuuuucaacaacug

SEQ ID NO: 667 - RNA, 19 nt, Homo sapiens
caacuggaaccgcauauuu

SEQ ID NO: 668 - RNA, 19 nt, Homo sapiens
cgcauauuuugaaguuaaa

SEQ ID NO: 669 - RNA, 19 nt, Homo sapiens
aaguuaaagaauaugucuu

SEQ ID NO: 670 - RNA, 19 nt, Homo sapiens
gaauaugucuugccacauu

SEQ ID NO: 671 - RNA, 19 nt, Homo sapiens
ccacauuuuucugucucaa

SEQ ID NO: 672 - RNA, 19 nt, Homo sapiens
cugucucaaucgagccaga

SEQ ID NO: 673 - RNA, 19 nt, Homo sapiens
caaucgagccagaauauaa

SEQ ID NO: 674 - RNA, 19 nt, Homo sapiens
gaauauaauuucauugguu

SEQ ID NO: 675 - RNA, 19 nt, Homo sapiens
auugguuacaagaacuuua

SEQ ID NO: 676 - RNA, 19 nt, Homo sapiens
agaacuuuaagaauuuuga

SEQ ID NO: 677 - RNA, 19 nt, Homo sapiens
gaauuuugaaauuacuaua

SEQ ID NO: 678 - RNA, 19 nt, Homo sapiens
gaaauuacuauaaaagcaa

SEQ ID NO: 679 - RNA, 19 nt, Homo sapiens
aaagcaagauauuuuuaua

SEQ ID NO: 680 - RNA, 19 nt, Homo sapiens
auauuuuuauaauaaagua

SEQ ID NO: 681 - RNA, 19 nt, Homo sapiens
aaguagucacugaggcuga

SEQ ID NO: 682 - RNA, 19 nt, Homo sapiens
cacugaggcugacguuuau

SEQ ID NO: 683 - RNA, 19 nt, Homo sapiens
cguuuauaucacauuugga

SEQ ID NO: 684 - RNA, 19 nt, Homo sapiens
cacauuuggaauaagagaa

SEQ ID NO: 685 - RNA, 19 nt, Homo sapiens
aauaagagaagacuuaaaa

SEQ ID NO: 686 - RNA, 19 nt, Homo sapiens
cuuaaaagaugaucaaaaa

SEQ ID NO: 687 - RNA, 19 nt, Homo sapiens
gaugaucaaaaagaaauga

SEQ ID NO: 688 - RNA, 19 nt, Homo sapiens
aaaugaugcaaacagcaau

SEQ ID NO: 689 - RNA, 19 nt, Homo sapiens
acagcaaugcaaaacacaa

SEQ ID NO: 690 - RNA, 19 nt, Homo sapiens
aaaacacaauguugauaaa

SEQ ID NO: 691 - RNA, 19 nt, Homo sapiens
caauguugauaaauggaau

SEQ ID NO: 692 - RNA, 19 nt, Homo sapiens
ggaauugcucaagucacau

SEQ ID NO: 693 - RNA, 19 nt, Homo sapiens
gcucaagucacauuugauu

SEQ ID NO: 694 - RNA, 19 nt, Homo sapiens
auuugauucugaaacagca

SEQ ID NO: 695 - RNA, 19 nt, Homo sapiens
ugaaacagcagucaaagaa

SEQ ID NO: 696 - RNA, 19 nt, Homo sapiens
caaagaacugucauacuac

SEQ ID NO: 697 - RNA, 19 nt, Homo sapiens
cauacuacaguuuagaaga

SEQ ID NO: 698 - RNA, 19 nt, Homo sapiens
caguuuagaagauuuaaac

SEQ ID NO: 699 - RNA, 19 nt, Homo sapiens
uaaacaacaaguaccuuua

SEQ ID NO: 700 - RNA, 19 nt, Homo sapiens
caaguaccuuuauauugcu

SEQ ID NO: 701 - RNA, 19 nt, Homo sapiens
uauugcuguaacagucaua

SEQ ID NO: 702 - RNA, 19 nt, Homo sapiens
aacagucauagagucuaca

SEQ ID NO: 703 - RNA, 19 nt, Homo sapiens
agagucuacagguggauuu

SEQ ID NO: 704 - RNA, 19 nt, Homo sapiens
ggauuuucugaagaggcag

SEQ ID NO: 705 - RNA, 19 nt, Homo sapiens
gaagaggcagaaauaccug

SEQ ID NO: 706 - RNA, 19 nt, Homo sapiens
agaaauaccuggcaucaaa

SEQ ID NO: 707 - RNA, 19 nt, Homo sapiens
gcaucaaauauguccucuc

SEQ ID NO: 708 - RNA, 19 nt, Homo sapiens
uguccucucucccuacaaa

SEQ ID NO: 709 - RNA, 19 nt, Homo sapiens
gaauuugguugcuacuccu

SEQ ID NO: 710 - RNA, 19 nt, Homo sapiens
gcuacuccucuuuuccuga

SEQ ID NO: 711 - RNA, 19 nt, Homo sapiens
cucuuuuccugaagccugg

SEQ ID NO: 712 - RNA, 19 nt, Homo sapiens
ccugggauuccauauccca

SEQ ID NO: 713 - RNA, 19 nt, Homo sapiens
cauaucccaucaaggugca

SEQ ID NO: 714 - RNA, 19 nt, Homo sapiens
ccaucaaggugcagguuaa

SEQ ID NO: 715 - RNA, 19 nt, Homo sapiens
cagguuaaagauucgcuug

SEQ ID NO: 716 - RNA, 19 nt, Homo sapiens
uucgcuugaccaguuggua

SEQ ID NO: 717 - RNA, 19 nt, Homo sapiens
ccaguugguaggaggaguc

SEQ ID NO: 718 - RNA, 19 nt, Homo sapiens
ggaggagucccaguaacac

SEQ ID NO: 719 - RNA, 19 nt, Homo sapiens
caguaacacugaaugcaca

SEQ ID NO: 720 - RNA, 19 nt, Homo sapiens
gaaugcacaaacaauugau

SEQ ID NO: 721 - RNA, 19 nt, Homo sapiens
aacaauugauguaaaccaa

SEQ ID NO: 722 - RNA, 19 nt, Homo sapiens
uaaaccaagagacaucuga

SEQ ID NO: 723 - RNA, 19 nt, Homo sapiens
caucugacuuggauccaag

SEQ ID NO: 724 - RNA, 19 nt, Homo sapiens
gauccaagcaaaaguguaa

SEQ ID NO: 725 - RNA, 19 nt, Homo sapiens
caaaaguguaacacguguu

SEQ ID NO: 726 - RNA, 19 nt, Homo sapiens
aacacguguugaugaugga

SEQ ID NO: 727 - RNA, 19 nt, Homo sapiens
ugauggaguagcuuccuuu

SEQ ID NO: 728 - RNA, 19 nt, Homo sapiens
guagcuuccuuugugcuua

SEQ ID NO: 729 - RNA, 19 nt, Homo sapiens
gcuuaaucucccaucugga

SEQ ID NO: 730 - RNA, 19 nt, Homo sapiens
ccaucuggagugacggugc

SEQ ID NO: 731 - RNA, 19 nt, Homo sapiens
ugacggugcuggaguuuaa

SEQ ID NO: 732 - RNA, 19 nt, Homo sapiens
gcuggaguuuaaugucaaa

SEQ ID NO: 733 - RNA, 19 nt, Homo sapiens
ugucaaaacugaugcucca

SEQ ID NO: 734 - RNA, 19 nt, Homo sapiens
gaugcuccagaucuuccag

SEQ ID NO: 735 - RNA, 19 nt, Homo sapiens
cagaucuuccagaagaaaa

SEQ ID NO: 736 - RNA, 19 nt, Homo sapiens
agaaaaucaggccagggaa

SEQ ID NO: 737 - RNA, 19 nt, Homo sapiens
ggccagggaagguuaccga

SEQ ID NO: 738 - RNA, 19 nt, Homo sapiens
guuaccgagcaauagcaua

SEQ ID NO: 739 - RNA, 19 nt, Homo sapiens
auagcauacucaucucuca

SEQ ID NO: 740 - RNA, 19 nt, Homo sapiens
uacucaucucucagccaaa

SEQ ID NO: 741 - RNA, 19 nt, Homo sapiens
gccaaaguuaccuuuauau

SEQ ID NO: 742 - RNA, 19 nt, Homo sapiens
ccuuuauauugauuggacu

SEQ ID NO: 743 - RNA, 19 nt, Homo sapiens
gauuggacugauaaccaua

SEQ ID NO: 744 - RNA, 19 nt, Homo sapiens
cugauaaccauaaggcuuu

SEQ ID NO: 745 - RNA, 19 nt, Homo sapiens
aggcuuugcuagugggaga

SEQ ID NO: 746 - RNA, 19 nt, Homo sapiens
gugggagaacaucugaaua

SEQ ID NO: 747 - RNA, 19 nt, Homo sapiens
caucugaauauuauuguua

SEQ ID NO: 748 - RNA, 19 nt, Homo sapiens
uauuauuguuacccccaaa

SEQ ID NO: 749 - RNA, 19 nt, Homo sapiens
cccaaaagcccauauauug

SEQ ID NO: 750 - RNA, 19 nt, Homo sapiens
ccaaaagcccauauauuga

SEQ ID NO: 751 - RNA, 19 nt, Homo sapiens
caaaagcccauauauugac

SEQ ID NO: 752 - RNA, 19 nt, Homo sapiens
aaaagcccauauauugaca

SEQ ID NO: 753 - RNA, 19 nt, Homo sapiens
aaagcccauauauugacaa

SEQ ID NO: 754 - RNA, 19 nt, Homo sapiens
aagcccauauauugacaaa

SEQ ID NO: 755 - RNA, 19 nt, Homo sapiens
agcccauauauugacaaaa

SEQ ID NO: 756 - RNA, 19 nt, Homo sapiens
gcccauauauugacaaaau

SEQ ID NO: 757 - RNA, 19 nt, Homo sapiens
cccauauauugacaaaaua

SEQ ID NO: 758 - RNA, 19 nt, Homo sapiens
ccauauauugacaaaauaa

SEQ ID NO: 759 - RNA, 19 nt, Homo sapiens
cauauauugacaaaauaac

SEQ ID NO: 760 - RNA, 19 nt, Homo sapiens
auauauugacaaaauaacu

SEQ ID NO: 761 - RNA, 19 nt, Homo sapiens
uauauugacaaaauaacuc

SEQ ID NO: 762 - RNA, 19 nt, Homo sapiens
auauugacaaaauaacuca

SEQ ID NO: 763 - RNA, 19 nt, Homo sapiens
uauugacaaaauaacucac

SEQ ID NO: 764 - RNA, 19 nt, Homo sapiens
auugacaaaauaacucacu

SEQ ID NO: 765 - RNA, 19 nt, Homo sapiens
uugacaaaauaacucacua

SEQ ID NO: 766 - RNA, 19 nt, Homo sapiens
ugacaaaauaacucacuau

SEQ ID NO: 767 - RNA, 19 nt, Homo sapiens
gacaaaauaacucacuaua

SEQ ID NO: 768 - RNA, 19 nt, Homo sapiens
aaaauaacucacuauaauu

SEQ ID NO: 769 - RNA, 19 nt, Homo sapiens
aaauaacucacuauaauua

SEQ ID NO: 770 - RNA, 19 nt, Homo sapiens
aauaacucacuauaauuac

SEQ ID NO: 771 - RNA, 19 nt, Homo sapiens
auaacucacuauaauuacu

SEQ ID NO: 772 - RNA, 19 nt, Homo sapiens
aacucacuauaauuacuug

SEQ ID NO: 773 - RNA, 19 nt, Homo sapiens
acucacuauaauuacuuga

SEQ ID NO: 774 - RNA, 19 nt, Homo sapiens
cucacuauaauuacuugau

SEQ ID NO: 775 - RNA, 19 nt, Homo sapiens
ucacuauaauuacuugauu

SEQ ID NO: 776 - RNA, 19 nt, Homo sapiens
acuauaauuacuugauuuu

SEQ ID NO: 777 - RNA, 19 nt, Homo sapiens
cuauaauuacuugauuuua

SEQ ID NO: 778 - RNA, 19 nt, Homo sapiens
uauaauuacuugauuuuau

SEQ ID NO: 779 - RNA, 19 nt, Homo sapiens
auaauuacuugauuuuauc

SEQ ID NO: 780 - RNA, 19 nt, Homo sapiens
uaauuacuugauuuuaucc

SEQ ID NO: 781 - RNA, 19 nt, Homo sapiens
aauuacuugauuuuaucca

SEQ ID NO: 782 - RNA, 19 nt, Homo sapiens
auuacuugauuuuauccaa

SEQ ID NO: 783 - RNA, 19 nt, Homo sapiens
uuauccaagggcaaaauua

SEQ ID NO: 784 - RNA, 19 nt, Homo sapiens
gcaaaauuauccacuuugg

SEQ ID NO: 785 - RNA, 19 nt, Homo sapiens
cacuuuggcacgagggaga

SEQ ID NO: 786 - RNA, 19 nt, Homo sapiens
cgagggagaaauuuucaga

SEQ ID NO: 787 - RNA, 19 nt, Homo sapiens
auuuucagaugcaucuuau

SEQ ID NO: 788 - RNA, 19 nt, Homo sapiens
gcaucuuaucaaaguauaa

SEQ ID NO: 789 - RNA, 19 nt, Homo sapiens
caaaguauaaacauuccag

SEQ ID NO: 790 - RNA, 19 nt, Homo sapiens
auuccaguaacacagaaca

SEQ ID NO: 791 - RNA, 19 nt, Homo sapiens
cacagaacaugguuccuuc

SEQ ID NO: 792 - RNA, 19 nt, Homo sapiens
gguuccuucaucccgacuu

SEQ ID NO: 793 - RNA, 19 nt, Homo sapiens
cccgacuucuggucuauua

SEQ ID NO: 794 - RNA, 19 nt, Homo sapiens
ggucuauuacaucgucaca

SEQ ID NO: 795 - RNA, 19 nt, Homo sapiens
aucgucacaggagaacaga

SEQ ID NO: 796 - RNA, 19 nt, Homo sapiens
caggagaacagacagcaga

SEQ ID NO: 797 - RNA, 19 nt, Homo sapiens
cagcagaauuagugucuga

SEQ ID NO: 798 - RNA, 19 nt, Homo sapiens
gugucugauucagucuggu

SEQ ID NO: 799 - RNA, 19 nt, Homo sapiens
cagucugguuaaauauuga

SEQ ID NO: 800 - RNA, 19 nt, Homo sapiens
guuaaauauugaagaaaaa

SEQ ID NO: 801 - RNA, 19 nt, Homo sapiens
agaaaaauguggcaaccag

SEQ ID NO: 802 - RNA, 19 nt, Homo sapiens
gcaaccagcuccagguuca

SEQ ID NO: 803 - RNA, 19 nt, Homo sapiens
gcuccagguucaucugucu

SEQ ID NO: 804 - RNA, 19 nt, Homo sapiens
aucugucuccugaugcaga

SEQ ID NO: 805 - RNA, 19 nt, Homo sapiens
gaugcagaugcauauucuc

SEQ ID NO: 806 - RNA, 19 nt, Homo sapiens
gcauauucuccaggccaaa

SEQ ID NO: 807 - RNA, 19 nt, Homo sapiens
aggccaaacugugucucuu

SEQ ID NO: 808 - RNA, 19 nt, Homo sapiens
gugucucuuaauauggcaa

SEQ ID NO: 809 - RNA, 19 nt, Homo sapiens
uuaauauggcaacuggaau

SEQ ID NO: 810 - RNA, 19 nt, Homo sapiens
aacuggaauggauuccugg

SEQ ID NO: 811 - RNA, 19 nt, Homo sapiens
uuccuggguggcauuagca

SEQ ID NO: 812 - RNA, 19 nt, Homo sapiens
ggcauuagcagcaguggac

SEQ ID NO: 813 - RNA, 19 nt, Homo sapiens
aguggacagugcuguguau

SEQ ID NO: 814 - RNA, 19 nt, Homo sapiens
gcuguguauggaguccaaa

SEQ ID NO: 815 - RNA, 19 nt, Homo sapiens
aguccaaagaggagccaaa

SEQ ID NO: 816 - RNA, 19 nt, Homo sapiens
agaggagccaaaaagcccu

SEQ ID NO: 817 - RNA, 19 nt, Homo sapiens
agcccuuggaaagaguauu

SEQ ID NO: 818 - RNA, 19 nt, Homo sapiens
aagaguauuucaauucuua

SEQ ID NO: 819 - RNA, 19 nt, Homo sapiens
uuucaauucuuagagaaga

SEQ ID NO: 820 - RNA, 19 nt, Homo sapiens
gagaagagugaucugggcu

SEQ ID NO: 821 - RNA, 19 nt, Homo sapiens
ugaucugggcuguggggca

SEQ ID NO: 822 - RNA, 19 nt, Homo sapiens
ggggcaggugguggccuca

SEQ ID NO: 823 - RNA, 19 nt, Homo sapiens
guggccucaacaaugccaa

SEQ ID NO: 824 - RNA, 19 nt, Homo sapiens
caacaaugccaauguguuc

SEQ ID NO: 825 - RNA, 19 nt, Homo sapiens
caauguguuccaccuagcu

SEQ ID NO: 826 - RNA, 19 nt, Homo sapiens
caccuagcuggacuuaccu

SEQ ID NO: 827 - RNA, 19 nt, Homo sapiens
gacuuaccuuccucacuaa

SEQ ID NO: 828 - RNA, 19 nt, Homo sapiens
ucacuaaugcaaaugcaga

SEQ ID NO: 829 - RNA, 19 nt, Homo sapiens
aaaugcagaugacucccaa

SEQ ID NO: 830 - RNA, 19 nt, Homo sapiens
cucccaagaaaaugaugaa

SEQ ID NO: 831 - RNA, 19 nt, Homo sapiens
ccuuguaaagaaauucuca

SEQ ID NO: 832 - RNA, 19 nt, Homo sapiens
aauucucaggccaagaaga

SEQ ID NO: 833 - RNA, 19 nt, Homo sapiens
ccaagaagaacgcugcaaa

SEQ ID NO: 834 - RNA, 19 nt, Homo sapiens
cgcugcaaaagaagauaga

SEQ ID NO: 835 - RNA, 19 nt, Homo sapiens
aaagaagauagaagaaaua

SEQ ID NO: 836 - RNA, 19 nt, Homo sapiens
agaaauagcugcuaaauau

SEQ ID NO: 837 - RNA, 19 nt, Homo sapiens
gcugcuaaauauaaacauu

SEQ ID NO: 838 - RNA, 19 nt, Homo sapiens
acauucaguagugaagaaa

SEQ ID NO: 839 - RNA, 19 nt, Homo sapiens
guagugaagaaauguuguu

SEQ ID NO: 840 - RNA, 19 nt, Homo sapiens
aaauguuguuacgauggag

SEQ ID NO: 841 - RNA, 19 nt, Homo sapiens
cgauggagccugcguuaau

SEQ ID NO: 842 - RNA, 19 nt, Homo sapiens
cguuaauaaugaugaaacc

SEQ ID NO: 843 - RNA, 19 nt, Homo sapiens
augaugaaaccugugagca

SEQ ID NO: 844 - RNA, 19 nt, Homo sapiens
cugugagcagcgagcugca

SEQ ID NO: 845 - RNA, 19 nt, Homo sapiens
cgagcugcacggauuaguu

SEQ ID NO: 846 - RNA, 19 nt, Homo sapiens
ggauuaguuuagggccaag

SEQ ID NO: 847 - RNA, 19 nt, Homo sapiens
gggccaagaugcaucaaag

SEQ ID NO: 848 - RNA, 19 nt, Homo sapiens
caucaaagcuuucacugaa

SEQ ID NO: 849 - RNA, 19 nt, Homo sapiens
gcuuucacugaauguugug

SEQ ID NO: 850 - RNA, 19 nt, Homo sapiens
aauguugugucgucgcaag

SEQ ID NO: 851 - RNA, 19 nt, Homo sapiens
cgucgcaagccagcuccgu

SEQ ID NO: 852 - RNA, 19 nt, Homo sapiens
gcuccgugcuaauaucucu

SEQ ID NO: 853 - RNA, 19 nt, Homo sapiens
cuaauaucucucauaaaga

SEQ ID NO: 854 - RNA, 19 nt, Homo sapiens
aaagacaugcaauugggaa

SEQ ID NO: 855 - RNA, 19 nt, Homo sapiens
caauugggaaggcuacaca

SEQ ID NO: 856 - RNA, 19 nt, Homo sapiens
gcuacacaugaagacccug

SEQ ID NO: 857 - RNA, 19 nt, Homo sapiens
caugaagacccuguuacca

SEQ ID NO: 858 - RNA, 19 nt, Homo sapiens
uaccaguaagcaagccaga

SEQ ID NO: 859 - RNA, 19 nt, Homo sapiens
agcaagccagaaauucgga

SEQ ID NO: 860 - RNA, 19 nt, Homo sapiens
agaaauucggaguuauuuu

SEQ ID NO: 861 - RNA, 19 nt, Homo sapiens
aguuauuuuccagaaagcu

SEQ ID NO: 862 - RNA, 19 nt, Homo sapiens
cagaaagcugguuguggga

SEQ ID NO: 863 - RNA, 19 nt, Homo sapiens
gugggaaguucaucuuguu

SEQ ID NO: 864 - RNA, 19 nt, Homo sapiens
ucaucuuguucccagaaga

SEQ ID NO: 865 - RNA, 19 nt, Homo sapiens
ccagaagaaaacaguugca

SEQ ID NO: 866 - RNA, 19 nt, Homo sapiens
caguugcaguuugcccuac

SEQ ID NO: 867 - RNA, 19 nt, Homo sapiens
caguuugcccuaccugauu

SEQ ID NO: 868 - RNA, 19 nt, Homo sapiens
ccugauucucuaaccaccu

SEQ ID NO: 869 - RNA, 19 nt, Homo sapiens
accaccugggaaauucaag

SEQ ID NO: 870 - RNA, 19 nt, Homo sapiens
gaaauucaaggcguuggca

SEQ ID NO: 871 - RNA, 19 nt, Homo sapiens
cguuggcauuucaaacacu

SEQ ID NO: 872 - RNA, 19 nt, Homo sapiens
cauuucaaacacugguaua

SEQ ID NO: 873 - RNA, 19 nt, Homo sapiens
guauauguguugcugauac

SEQ ID NO: 874 - RNA, 19 nt, Homo sapiens
ugcugauacugucaaggca

SEQ ID NO: 875 - RNA, 19 nt, Homo sapiens
cugucaaggcaaagguguu

SEQ ID NO: 876 - RNA, 19 nt, Homo sapiens
agguguucaaagaugucuu

SEQ ID NO: 877 - RNA, 19 nt, Homo sapiens
caaagaugucuuccuggaa

SEQ ID NO: 878 - RNA, 19 nt, Homo sapiens
cuuccuggaaaugaauaua

SEQ ID NO: 879 - RNA, 19 nt, Homo sapiens
gaauauaccauauucuguu

SEQ ID NO: 880 - RNA, 19 nt, Homo sapiens
auauucuguuguacgagga

SEQ ID NO: 881 - RNA, 19 nt, Homo sapiens
cgaggagaacagauccaau

SEQ ID NO: 882 - RNA, 19 nt, Homo sapiens
gaacagauccaauugaaag

SEQ ID NO: 883 - RNA, 19 nt, Homo sapiens
gaaaggaacuguuuacaac

SEQ ID NO: 884 - RNA, 19 nt, Homo sapiens
acuguuuacaacuauagga

SEQ ID NO: 885 - RNA, 19 nt, Homo sapiens
aacuauaggacuucuggga

SEQ ID NO: 886 - RNA, 19 nt, Homo sapiens
ugggaugcaguucuguguu

SEQ ID NO: 887 - RNA, 19 nt, Homo sapiens
guucuguguuaaaaugucu

SEQ ID NO: 888 - RNA, 19 nt, Homo sapiens
uuaaaaugucugcugugga

SEQ ID NO: 889 - RNA, 19 nt, Homo sapiens
cuguggagggaaucugcac

SEQ ID NO: 890 - RNA, 19 nt, Homo sapiens
ggaaucugcacuucggaaa

SEQ ID NO: 891 - RNA, 19 nt, Homo sapiens
cggaaagcccagucauuga

SEQ ID NO: 892 - RNA, 19 nt, Homo sapiens
ccagucauugaucaucagg

SEQ ID NO: 893 - RNA, 19 nt, Homo sapiens
caucagggcacaaaguccu

SEQ ID NO: 894 - RNA, 19 nt, Homo sapiens
ggcacaaaguccuccaaau

SEQ ID NO: 895 - RNA, 19 nt, Homo sapiens
caaaugugugcgccagaaa

SEQ ID NO: 896 - RNA, 19 nt, Homo sapiens
gcgccagaaaguagagggc

SEQ ID NO: 897 - RNA, 19 nt, Homo sapiens
aguagagggcuccuccagu

SEQ ID NO: 898 - RNA, 19 nt, Homo sapiens
ccuccagucacuuggugac

SEQ ID NO: 899 - RNA, 19 nt, Homo sapiens
ucacuuggugacauucacu

SEQ ID NO: 900 - RNA, 19 nt, Homo sapiens
cauucacugugcuuccucu

SEQ ID NO: 901 - RNA, 19 nt, Homo sapiens
ggaaauuggccuucacaac

SEQ ID NO: 902 - RNA, 19 nt, Homo sapiens
cuucacaacaucaauuuuu

SEQ ID NO: 903 - RNA, 19 nt, Homo sapiens
aauuuuucacuggagacuu

SEQ ID NO: 904 - RNA, 19 nt, Homo sapiens
cuggagacuugguuuggaa

SEQ ID NO: 905 - RNA, 19 nt, Homo sapiens
gguuuggaaaagaaaucuu

SEQ ID NO: 906 - RNA, 19 nt, Homo sapiens
aaucuuaguaaaaacauua

SEQ ID NO: 907 - RNA, 19 nt, Homo sapiens
aaaaacauuacgaguggug

SEQ ID NO: 908 - RNA, 19 nt, Homo sapiens
gaguggugccagaaggugu

SEQ ID NO: 909 - RNA, 19 nt, Homo sapiens
agaaggugucaaaagggaa

SEQ ID NO: 910 - RNA, 19 nt, Homo sapiens
ugucaaaagggaaagcuau

SEQ ID NO: 911 - RNA, 19 nt, Homo sapiens
gcuauucugguguuacuuu

SEQ ID NO: 912 - RNA, 19 nt, Homo sapiens
guguuacuuuggauccuag

SEQ ID NO: 913 - RNA, 19 nt, Homo sapiens
ggauccuagggguauuuau

SEQ ID NO: 914 - RNA, 19 nt, Homo sapiens
gguauuuaugguaccauua

SEQ ID NO: 915 - RNA, 19 nt, Homo sapiens
guaccauuagcagacgaaa

SEQ ID NO: 916 - RNA, 19 nt, Homo sapiens
cagacgaaaggaguuccca

SEQ ID NO: 917 - RNA, 19 nt, Homo sapiens
aggaguucccauacaggau

SEQ ID NO: 918 - RNA, 19 nt, Homo sapiens
cauacaggauacccuuaga

SEQ ID NO: 919 - RNA, 19 nt, Homo sapiens
cuuagauuugguccccaaa

SEQ ID NO: 920 - RNA, 19 nt, Homo sapiens
uccccaaaacagaaaucaa

SEQ ID NO: 921 - RNA, 19 nt, Homo sapiens
acagaaaucaaaaggauuu

SEQ ID NO: 922 - RNA, 19 nt, Homo sapiens
aaaggauuuugaguguaaa

SEQ ID NO: 923 - RNA, 19 nt, Homo sapiens
aguguaaaaggacugcuug

SEQ ID NO: 924 - RNA, 19 nt, Homo sapiens
aaggacugcuuguagguga

SEQ ID NO: 925 - RNA, 19 nt, Homo sapiens
guaggugagaucuugucug

SEQ ID NO: 926 - RNA, 19 nt, Homo sapiens
aucuugucugcaguucuaa

SEQ ID NO: 927 - RNA, 19 nt, Homo sapiens
guucuaagucaggaaggca

SEQ ID NO: 928 - RNA, 19 nt, Homo sapiens
gaaggcaucaauauccuaa

SEQ ID NO: 929 - RNA, 19 nt, Homo sapiens
ucaauauccuaacccaccu

SEQ ID NO: 930 - RNA, 19 nt, Homo sapiens
ccaccuccccaaagggagu

SEQ ID NO: 931 - RNA, 19 nt, Homo sapiens
ccccaaagggagugcagag

SEQ ID NO: 932 - RNA, 19 nt, Homo sapiens
gugcagaggcggagcugau

SEQ ID NO: 933 - RNA, 19 nt, Homo sapiens
ggagcugaugagcguuguc

SEQ ID NO: 934 - RNA, 19 nt, Homo sapiens
cguugucccaguauucuau

SEQ ID NO: 935 - RNA, 19 nt, Homo sapiens
ccaguauucuauguuuuuc

SEQ ID NO: 936 - RNA, 19 nt, Homo sapiens
guuuuucacuaccuggaaa

SEQ ID NO: 937 - RNA, 19 nt, Homo sapiens
ccuggaaacaggaaaucau

SEQ ID NO: 938 - RNA, 19 nt, Homo sapiens
ggaacauuuuucauucuga

SEQ ID NO: 939 - RNA, 19 nt, Homo sapiens
cauucugacccauuaauug

SEQ ID NO: 940 - RNA, 19 nt, Homo sapiens
ccauuaauugaaaagcaga

SEQ ID NO: 941 - RNA, 19 nt, Homo sapiens
aaagcagaaacugaagaaa

SEQ ID NO: 942 - RNA, 19 nt, Homo sapiens
aacugaagaaaaaauuaaa

SEQ ID NO: 943 - RNA, 19 nt, Homo sapiens
aaaaaauuaaaagaaggga

SEQ ID NO: 944 - RNA, 19 nt, Homo sapiens
agggauguugagcauuaug

SEQ ID NO: 945 - RNA, 19 nt, Homo sapiens
gagcauuauguccuacaga

SEQ ID NO: 946 - RNA, 19 nt, Homo sapiens
uguccuacagaaaugcuga

SEQ ID NO: 947 - RNA, 19 nt, Homo sapiens
aaugcugacuacucuuaca

SEQ ID NO: 948 - RNA, 19 nt, Homo sapiens
uacucuuacagugugugga

SEQ ID NO: 949 - RNA, 19 nt, Homo sapiens
aguguguggaaggguggaa

SEQ ID NO: 950 - RNA, 19 nt, Homo sapiens
ggguggaagugcuagcacu

SEQ ID NO: 951 - RNA, 19 nt, Homo sapiens
gcuagcacuugguuaacag

SEQ ID NO: 952 - RNA, 19 nt, Homo sapiens
gguuaacagcuuuugcuuu

SEQ ID NO: 953 - RNA, 19 nt, Homo sapiens
ugcuuuaagaguacuugga

SEQ ID NO: 954 - RNA, 19 nt, Homo sapiens
guacuuggacaaguaaaua

SEQ ID NO: 955 - RNA, 19 nt, Homo sapiens
caaguaaauaaauacguag

SEQ ID NO: 956 - RNA, 19 nt, Homo sapiens
auaaauacguagagcagaa

SEQ ID NO: 957 - RNA, 19 nt, Homo sapiens
gagcagaaccaaaauucaa

SEQ ID NO: 958 - RNA, 19 nt, Homo sapiens
aauucaauuuguaauucuu

SEQ ID NO: 959 - RNA, 19 nt, Homo sapiens
guaauucuuuauuguggcu

SEQ ID NO: 960 - RNA, 19 nt, Homo sapiens
auuguggcuaguugagaau

SEQ ID NO: 961 - RNA, 19 nt, Homo sapiens
cuaguugagaauuaucaau

SEQ ID NO: 962 - RNA, 19 nt, Homo sapiens
uuaucaauuagauaaugga

SEQ ID NO: 963 - RNA, 19 nt, Homo sapiens
aauggaucuuucaaggaaa

SEQ ID NO: 964 - RNA, 19 nt, Homo sapiens
cuuucaaggaaaauucaca

SEQ ID NO: 965 - RNA, 19 nt, Homo sapiens
aauucacaguaucaaccaa

SEQ ID NO: 966 - RNA, 19 nt, Homo sapiens
guaucaaccaauaaaauua

SEQ ID NO: 967 - RNA, 19 nt, Homo sapiens
aaaauuacaggguaccuug

SEQ ID NO: 968 - RNA, 19 nt, Homo sapiens
aggguaccuugccuguuga

SEQ ID NO: 969 - RNA, 19 nt, Homo sapiens
guugaagcccgagagaaca

SEQ ID NO: 970 - RNA, 19 nt, Homo sapiens
ccgagagaacagcuuauau

SEQ ID NO: 971 - RNA, 19 nt, Homo sapiens
gcuuauaucuuacagccuu

SEQ ID NO: 972 - RNA, 19 nt, Homo sapiens
cuuacagccuuuacuguga

SEQ ID NO: 973 - RNA, 19 nt, Homo sapiens
gaauuagaaaggcuuucga

SEQ ID NO: 974 - RNA, 19 nt, Homo sapiens
ggcuuucgauauaugcccc

SEQ ID NO: 975 - RNA, 19 nt, Homo sapiens
gauauaugcccccugguga

SEQ ID NO: 976 - RNA, 19 nt, Homo sapiens
ggugaaaaucgacacagcu

SEQ ID NO: 977 - RNA, 19 nt, Homo sapiens
cgacacagcucuaauuaaa

SEQ ID NO: 978 - RNA, 19 nt, Homo sapiens
gcucuaauuaaagcugaca

SEQ ID NO: 979 - RNA, 19 nt, Homo sapiens
cugacaacuuucugcuuga

SEQ ID NO: 980 - RNA, 19 nt, Homo sapiens
cuuucugcuugaaaauaca

SEQ ID NO: 981 - RNA, 19 nt, Homo sapiens
aaaauacacugccagccca

SEQ ID NO: 982 - RNA, 19 nt, Homo sapiens
agcccagagcaccuuuaca

SEQ ID NO: 983 - RNA, 19 nt, Homo sapiens
gcaccuuuacauuggccau

SEQ ID NO: 984 - RNA, 19 nt, Homo sapiens
acauuggccauuucugcgu

SEQ ID NO: 985 - RNA, 19 nt, Homo sapiens
cugcguaugcucuuucccu

SEQ ID NO: 986 - RNA, 19 nt, Homo sapiens
cuuucccugggagauaaaa

SEQ ID NO: 987 - RNA, 19 nt, Homo sapiens
gagauaaaacucacccaca

SEQ ID NO: 988 - RNA, 19 nt, Homo sapiens
acucacccacaguuucguu

SEQ ID NO: 989 - RNA, 19 nt, Homo sapiens
caguuucguucaauuguuu

SEQ ID NO: 990 - RNA, 19 nt, Homo sapiens
caauuguuucagcuuugaa

SEQ ID NO: 991 - RNA, 19 nt, Homo sapiens
cuuugaagagagaagcuuu

SEQ ID NO: 992 - RNA, 19 nt, Homo sapiens
gagagaagcuuugguuaaa

SEQ ID NO: 993 - RNA, 19 nt, Homo sapiens
guuaaagguaauccaccca

SEQ ID NO: 994 - RNA, 19 nt, Homo sapiens
aauccacccauuuaucguu

SEQ ID NO: 995 - RNA, 19 nt, Homo sapiens
cauuuaucguuuuuggaaa

SEQ ID NO: 996 - RNA, 19 nt, Homo sapiens
uuuggaaagacaaucuuca

SEQ ID NO: 997 - RNA, 19 nt, Homo sapiens
aaucuucagcauaaagaca

SEQ ID NO: 998 - RNA, 19 nt, Homo sapiens
cauaaagacagcucuguac

SEQ ID NO: 999 - RNA, 19 nt, Homo sapiens
cucuguaccuaacacuggu

SEQ ID NO: 1000 - RNA, 19 nt, Homo sapiens
acacugguacggcacguau

SEQ ID NO: 1001 - RNA, 19 nt, Homo sapiens
ggcacguaugguagaaaca

SEQ ID NO: 1002 - RNA, 19 nt, Homo sapiens
gguagaaacaacugccuau

SEQ ID NO: 1003 - RNA, 19 nt, Homo sapiens
caacugccuaugcuuuacu

SEQ ID NO: 1004 - RNA, 19 nt, Homo sapiens
cuuuacucaccagucugaa

SEQ ID NO: 1005 - RNA, 19 nt, Homo sapiens
gucugaacuugaaagauau

SEQ ID NO: 1006 - RNA, 19 nt, Homo sapiens
acuugaaagauauaaauua

SEQ ID NO: 1007 - RNA, 19 nt, Homo sapiens
uauaaauuauguuaaccca

SEQ ID NO: 1008 - RNA, 19 nt, Homo sapiens
guuaacccagucaucaaau

SEQ ID NO: 1009 - RNA, 19 nt, Homo sapiens
ucaucaaauggcuaucaga

SEQ ID NO: 1010 - RNA, 19 nt, Homo sapiens
uaucagaagagcagaggua

SEQ ID NO: 1011 - RNA, 19 nt, Homo sapiens
agagguauggagguggcuu

SEQ ID NO: 1012 - RNA, 19 nt, Homo sapiens
gagguggcuuuuauucaac

SEQ ID NO: 1013 - RNA, 19 nt, Homo sapiens
uauucaacccaggacacaa

SEQ ID NO: 1014 - RNA, 19 nt, Homo sapiens
aggacacaaucaaugccau

SEQ ID NO: 1015 - RNA, 19 nt, Homo sapiens
caaucaaugccauugaggg

SEQ ID NO: 1016 - RNA, 19 nt, Homo sapiens
cauugagggccugacggaa

SEQ ID NO: 1017 - RNA, 19 nt, Homo sapiens
acggaauauucacuccugg

SEQ ID NO: 1018 - RNA, 19 nt, Homo sapiens
uucacuccugguuaaacaa

SEQ ID NO: 1019 - RNA, 19 nt, Homo sapiens
gguuaaacaacuccgcuug

SEQ ID NO: 1020 - RNA, 19 nt, Homo sapiens
ccgcuugaguauggacauc

SEQ ID NO: 1021 - RNA, 19 nt, Homo sapiens
ggacaucgauguuucuuac

SEQ ID NO: 1022 - RNA, 19 nt, Homo sapiens
cgauguuucuuacaagcau

SEQ ID NO: 1023 - RNA, 19 nt, Homo sapiens
caagcauaaaggugccuua

SEQ ID NO: 1024 - RNA, 19 nt, Homo sapiens
gugccuuacauaauuauaa

SEQ ID NO: 1025 - RNA, 19 nt, Homo sapiens
acauaauuauaaaaugaca

SEQ ID NO: 1026 - RNA, 19 nt, Homo sapiens
aaaaugacagacaagaauu

SEQ ID NO: 1027 - RNA, 19 nt, Homo sapiens
caagaauuuccuugggagg

SEQ ID NO: 1028 - RNA, 19 nt, Homo sapiens
ccuugggaggccaguagag

SEQ ID NO: 1029 - RNA, 19 nt, Homo sapiens
aguagaggugcuucucaau

SEQ ID NO: 1030 - RNA, 19 nt, Homo sapiens
cuucucaaugaugaccuca

SEQ ID NO: 1031 - RNA, 19 nt, Homo sapiens
ugaccucauugucaguaca

SEQ ID NO: 1032 - RNA, 19 nt, Homo sapiens
gucaguacaggauuuggca

SEQ ID NO: 1033 - RNA, 19 nt, Homo sapiens
aggauuuggcaguggcuug

SEQ ID NO: 1034 - RNA, 19 nt, Homo sapiens
uggcuuggcuacaguacau

SEQ ID NO: 1035 - RNA, 19 nt, Homo sapiens
gcuacaguacauguaacaa

SEQ ID NO: 1036 - RNA, 19 nt, Homo sapiens
aacaacuguaguucacaaa

SEQ ID NO: 1037 - RNA, 19 nt, Homo sapiens
guaguucacaaaaccagua

SEQ ID NO: 1038 - RNA, 19 nt, Homo sapiens
aaaccaguaccucugagga

SEQ ID NO: 1039 - RNA, 19 nt, Homo sapiens
ugaggaaguuugcagcuuu

SEQ ID NO: 1040 - RNA, 19 nt, Homo sapiens
ugcagcuuuuauuugaaaa

SEQ ID NO: 1041 - RNA, 19 nt, Homo sapiens
auuugaaaaucgauacuca

SEQ ID NO: 1042 - RNA, 19 nt, Homo sapiens
cgauacucaggauauugaa

SEQ ID NO: 1043 - RNA, 19 nt, Homo sapiens
ggauauugaagcaucccac

SEQ ID NO: 1044 - RNA, 19 nt, Homo sapiens
gaagcaucccacuacagag

SEQ ID NO: 1045 - RNA, 19 nt, Homo sapiens
acuacagaggcuacggaaa

SEQ ID NO: 1046 - RNA, 19 nt, Homo sapiens
cggaaacucugauuacaaa

SEQ ID NO: 1047 - RNA, 19 nt, Homo sapiens
ugauuacaaacgcauagua

SEQ ID NO: 1048 - RNA, 19 nt, Homo sapiens
gcauaguagcaugugccag

SEQ ID NO: 1049 - RNA, 19 nt, Homo sapiens
gcaugugccagcuacaagc

SEQ ID NO: 1050 - RNA, 19 nt, Homo sapiens
cuacaagcccagcagggaa

SEQ ID NO: 1051 - RNA, 19 nt, Homo sapiens
cagcagggaagaaucauca

SEQ ID NO: 1052 - RNA, 19 nt, Homo sapiens
gaaucaucaucuggauccu

SEQ ID NO: 1053 - RNA, 19 nt, Homo sapiens
gauccucucaugcggugau

SEQ ID NO: 1054 - RNA, 19 nt, Homo sapiens
cucaugcggugauggacau

SEQ ID NO: 1055 - RNA, 19 nt, Homo sapiens
gauggacaucuccuugccu

SEQ ID NO: 1056 - RNA, 19 nt, Homo sapiens
cuugccuacuggaaucagu

SEQ ID NO: 1057 - RNA, 19 nt, Homo sapiens
gaaucagugcaaaugaaga

SEQ ID NO: 1058 - RNA, 19 nt, Homo sapiens
aaaugaagaagacuuaaaa

SEQ ID NO: 1059 - RNA, 19 nt, Homo sapiens
gaagacuuaaaagcccuug

SEQ ID NO: 1060 - RNA, 19 nt, Homo sapiens
ccuuguggaagggguggau

SEQ ID NO: 1061 - RNA, 19 nt, Homo sapiens
gaagggguggaucaacuau

SEQ ID NO: 1062 - RNA, 19 nt, Homo sapiens
aucaacuauucacugauua

SEQ ID NO: 1063 - RNA, 19 nt, Homo sapiens
cacugauuaccaaaucaaa

SEQ ID NO: 1064 - RNA, 19 nt, Homo sapiens
aucaaagauggacauguua

SEQ ID NO: 1065 - RNA, 19 nt, Homo sapiens
ggacauguuauucugcaac

SEQ ID NO: 1066 - RNA, 19 nt, Homo sapiens
ucugcaacugaauucgauu

SEQ ID NO: 1067 - RNA, 19 nt, Homo sapiens
gaauucgauucccuccagu

SEQ ID NO: 1068 - RNA, 19 nt, Homo sapiens
cccuccagugauuuccuuu

SEQ ID NO: 1069 - RNA, 19 nt, Homo sapiens
gauuuccuuuguguacgau

SEQ ID NO: 1070 - RNA, 19 nt, Homo sapiens
guacgauuccggauauuug

SEQ ID NO: 1071 - RNA, 19 nt, Homo sapiens
cggauauuugaacucuuug

SEQ ID NO: 1072 - RNA, 19 nt, Homo sapiens
acucuuugaaguuggguuu

SEQ ID NO: 1073 - RNA, 19 nt, Homo sapiens
aguuggguuucucaguccu

SEQ ID NO: 1074 - RNA, 19 nt, Homo sapiens
uucucaguccugccacuuu

SEQ ID NO: 1075 - RNA, 19 nt, Homo sapiens
cacuuucacaguguacgaa

SEQ ID NO: 1076 - RNA, 19 nt, Homo sapiens
cacaguguacgaauaccac

SEQ ID NO: 1077 - RNA, 19 nt, Homo sapiens
accacagaccagauaaaca

SEQ ID NO: 1078 - RNA, 19 nt, Homo sapiens
ccagauaaacaguguacca

SEQ ID NO: 1079 - RNA, 19 nt, Homo sapiens
caguguaccauguuuuaua

SEQ ID NO: 1080 - RNA, 19 nt, Homo sapiens
guuuuauagcacuuccaau

SEQ ID NO: 1081 - RNA, 19 nt, Homo sapiens
cuuccaauaucaaaauuca

SEQ ID NO: 1082 - RNA, 19 nt, Homo sapiens
aucaaaauucagaaagucu

SEQ ID NO: 1083 - RNA, 19 nt, Homo sapiens
gaaagucugugaaggagcc

SEQ ID NO: 1084 - RNA, 19 nt, Homo sapiens
gaaggagccgcgugcaagu

SEQ ID NO: 1085 - RNA, 19 nt, Homo sapiens
cgugcaaguguguagaagc

SEQ ID NO: 1086 - RNA, 19 nt, Homo sapiens
guagaagcugauugugggc

SEQ ID NO: 1087 - RNA, 19 nt, Homo sapiens
cugauugugggcaaaugca

SEQ ID NO: 1088 - RNA, 19 nt, Homo sapiens
gcaaaugcaggaagaauug

SEQ ID NO: 1089 - RNA, 19 nt, Homo sapiens
gaagaauuggaucugacaa

SEQ ID NO: 1090 - RNA, 19 nt, Homo sapiens
cugacaaucucugcagaga

SEQ ID NO: 1091 - RNA, 19 nt, Homo sapiens
gcagagacaagaaaacaaa

SEQ ID NO: 1092 - RNA, 19 nt, Homo sapiens
caagaaaacaaacagcaug

SEQ ID NO: 1093 - RNA, 19 nt, Homo sapiens
acagcauguaaaccagaga

SEQ ID NO: 1094 - RNA, 19 nt, Homo sapiens
ccagagauugcauaugcuu

SEQ ID NO: 1095 - RNA, 19 nt, Homo sapiens
gcauaugcuuauaaaguua

SEQ ID NO: 1096 - RNA, 19 nt, Homo sapiens
uuauaaaguuagcaucaca

SEQ ID NO: 1097 - RNA, 19 nt, Homo sapiens
caucacauccaucacugua

SEQ ID NO: 1098 - RNA, 19 nt, Homo sapiens
ucacuguagaaaauguuuu

SEQ ID NO: 1099 - RNA, 19 nt, Homo sapiens
agaaaauguuuuugucaag

SEQ ID NO: 1100 - RNA, 19 nt, Homo sapiens
uuugucaaguacaaggcaa

SEQ ID NO: 1101 - RNA, 19 nt, Homo sapiens
aggcaacccuucuggauau

SEQ ID NO: 1102 - RNA, 19 nt, Homo sapiens
ccuucuggauaucuacaaa

SEQ ID NO: 1103 - RNA, 19 nt, Homo sapiens
uaucuacaaaacuggggaa

SEQ ID NO: 1104 - RNA, 19 nt, Homo sapiens
cuggggaagcuguugcuga

SEQ ID NO: 1105 - RNA, 19 nt, Homo sapiens
cuguugcugagaaagacuc

SEQ ID NO: 1106 - RNA, 19 nt, Homo sapiens
gacucugagauuaccuuca

SEQ ID NO: 1107 - RNA, 19 nt, Homo sapiens
gagauuaccuucauuaaaa

SEQ ID NO: 1108 - RNA, 19 nt, Homo sapiens
auuaaaaagguaaccugua

SEQ ID NO: 1109 - RNA, 19 nt, Homo sapiens
uaaccuguacuaacgcuga

SEQ ID NO: 1110 - RNA, 19 nt, Homo sapiens
cuaacgcugagcugguaaa

SEQ ID NO: 1111 - RNA, 19 nt, Homo sapiens
gguaaaaggaagacaguac

SEQ ID NO: 1112 - RNA, 19 nt, Homo sapiens
gaagacaguacuuaauuau

SEQ ID NO: 1113 - RNA, 19 nt, Homo sapiens
cuuaauuauggguaaagaa

SEQ ID NO: 1114 - RNA, 19 nt, Homo sapiens
uaaagaagcccuccagaua

SEQ ID NO: 1115 - RNA, 19 nt, Homo sapiens
ccuccagauaaaauacaau

SEQ ID NO: 1116 - RNA, 19 nt, Homo sapiens
aaauacaauuucaguuuca

SEQ ID NO: 1117 - RNA, 19 nt, Homo sapiens
caguuucagguacaucuac

SEQ ID NO: 1118 - RNA, 19 nt, Homo sapiens
gguacaucuacccuuuaga

SEQ ID NO: 1119 - RNA, 19 nt, Homo sapiens
ccuuuagauuccuugaccu

SEQ ID NO: 1120 - RNA, 19 nt, Homo sapiens
ccuugaccuggauugaaua

SEQ ID NO: 1121 - RNA, 19 nt, Homo sapiens
ggauugaauacuggccuag

SEQ ID NO: 1122 - RNA, 19 nt, Homo sapiens
cuggccuagagacacaaca

SEQ ID NO: 1123 - RNA, 19 nt, Homo sapiens
gagacacaacauguucauc

SEQ ID NO: 1124 - RNA, 19 nt, Homo sapiens
guucaucgugucaagcauu

SEQ ID NO: 1125 - RNA, 19 nt, Homo sapiens
gucaagcauuuuuagcuaa

SEQ ID NO: 1126 - RNA, 19 nt, Homo sapiens
agcuaauuuagaugaauuu

SEQ ID NO: 1127 - RNA, 19 nt, Homo sapiens
agaugaauuugccgaagau

SEQ ID NO: 1128 - RNA, 19 nt, Homo sapiens
ccgaagauaucuuuuuaaa

SEQ ID NO: 1129 - RNA, 19 nt, Homo sapiens
cuuuuuaaauggaugcuaa

SEQ ID NO: 1130 - RNA, 19 nt, Homo sapiens
ggaugcuaaaauuccugaa

SEQ ID NO: 1131 - RNA, 19 nt, Homo sapiens
uaaaauuccugaaguucag

SEQ ID NO: 1132 - RNA, 19 nt, Homo sapiens
aguucagcugcauacaguu

SEQ ID NO: 1133 - RNA, 19 nt, Homo sapiens
gcauacaguuugcacuuau

SEQ ID NO: 1134 - RNA, 19 nt, Homo sapiens
acuuauggacuccuguugu

SEQ ID NO: 1135 - RNA, 19 nt, Homo sapiens
ggacuccuguuguugaagu

SEQ ID NO: 1136 - RNA, 19 nt, Homo sapiens
uguugaaguucguuuuuuu

SEQ ID NO: 1137 - RNA, 19 nt, Homo sapiens
uuuuuuguuuucuucuuuu

SEQ ID NO: 1138 - RNA, 19 nt, Homo sapiens
ucuucuuuuuuuaaacauu

SEQ ID NO: 1139 - RNA, 19 nt, Homo sapiens
uuuuuaaacauucauagcu

SEQ ID NO: 1140 - RNA, 19 nt, Homo sapiens
auagcuggucuuauuugua

SEQ ID NO: 1141 - RNA, 19 nt, Homo sapiens
gucuuauuuguaaagcuca

SEQ ID NO: 1142 - RNA, 19 nt, Homo sapiens
aaagcucacuuuacuuaga

SEQ ID NO: 1143 - RNA, 19 nt, Homo sapiens
acuuagaauuaguggcacu

SEQ ID NO: 1144 - RNA, 19 nt, Homo sapiens
aguggcacuugcuuuuauu

SEQ ID NO: 1145 - RNA, 19 nt, Homo sapiens
gcuuuuauuagagaaugau

SEQ ID NO: 1146 - RNA, 19 nt, Homo sapiens
gagaaugauuucaaaugcu

SEQ ID NO: 1147 - RNA, 19 nt, Homo sapiens
uuucaaaugcuguaacuuu

SEQ ID NO: 1148 - RNA, 19 nt, Homo sapiens
guaacuuucugaaauaaca

SEQ ID NO: 1149 - RNA, 19 nt, Homo sapiens
gaaauaacauggccuugga

SEQ ID NO: 1150 - RNA, 19 nt, Homo sapiens
ccuuggagggcaugaagac

SEQ ID NO: 1151 - RNA, 19 nt, Homo sapiens
agggcaugaagacagauac

SEQ ID NO: 1152 - RNA, 19 nt, Homo sapiens
gauacuccuccaagguuau

SEQ ID NO: 1153 - RNA, 19 nt, Homo sapiens
ccuccaagguuauuggaca

SEQ ID NO: 1154 - RNA, 19 nt, Homo sapiens
ggacaccggaaacaauaaa

SEQ ID NO: 1155 - RNA, 19 nt, Homo sapiens
gaaacaauaaauuggaaca

SEQ ID NO: 1156 - RNA, 19 nt, Homo sapiens
auuggaacaccuccucaaa

SEQ ID NO: 1157 - RNA, 19 nt, Homo sapiens
uccucaaaccuaccacuca

SEQ ID NO: 1158 - RNA, 19 nt, Homo sapiens
cuaccacucaggaauguuu

SEQ ID NO: 1159 - RNA, 19 nt, Homo sapiens
aauguuugcuggggccgaa

SEQ ID NO: 1160 - RNA, 19 nt, Homo sapiens
ugcuggggccgaaagaaca

SEQ ID NO: 1161 - RNA, 19 nt, Homo sapiens
aaagaacaguccauugaaa

SEQ ID NO: 1162 - RNA, 19 nt, Homo sapiens
cauugaaagggaguauuac

SEQ ID NO: 1163 - RNA, 19 nt, Homo sapiens
ggaguauuacaaaaacaug

SEQ ID NO: 1164 - RNA, 19 nt, Homo sapiens
aaaacauggccuuugcuug

SEQ ID NO: 1165 - RNA, 19 nt, Homo sapiens
gccuuugcuugaaagaaaa

SEQ ID NO: 1166 - RNA, 19 nt, Homo sapiens
gaaagaaaauaccaaggaa

SEQ ID NO: 1167 - RNA, 19 nt, Homo sapiens
ccaaggaacaggaaacuga

SEQ ID NO: 1168 - RNA, 19 nt, Homo sapiens
aacugaucauuaaagccug

SEQ ID NO: 1169 - RNA, 19 nt, Homo sapiens
auuaaagccugaguuugcu

SEQ ID NO: 1170 - RNA, 19 nt, Homo sapiens
uagcaggaaaccacggaua

SEQ ID NO: 1171 - RNA, 19 nt, Homo sapiens
uuggagguagcaggaaacc

SEQ ID NO: 1172 - RNA, 19 nt, Homo sapiens
aaaggcccaugguuggagg

SEQ ID NO: 1173 - RNA, 19 nt, Homo sapiens
aaguauucccaaaaggccc

SEQ ID NO: 1174 - RNA, 19 nt, Homo sapiens
uuaaaaaacaaaguauucc

SEQ ID NO: 1175 - RNA, 19 nt, Homo sapiens
ggaagauuaaaaaacaaag

SEQ ID NO: 1176 - RNA, 19 nt, Homo sapiens
ccagguuuuccccaggaag

SEQ ID NO: 1177 - RNA, 19 nt, Homo sapiens
uccuguccccagguuuucc

SEQ ID NO: 1178 - RNA, 19 nt, Homo sapiens
auauguuugcuccuguccc

SEQ ID NO: 1179 - RNA, 19 nt, Homo sapiens
cugaaaugacauauguuug

SEQ ID NO: 1180 - RNA, 19 nt, Homo sapiens
uauuuuuggugcugaaaug

SEQ ID NO: 1181 - RNA, 19 nt, Homo sapiens
cacggaauauuuuuggugc

SEQ ID NO: 1182 - RNA, 19 nt, Homo sapiens
uucagaugcuccaacacgg

SEQ ID NO: 1183 - RNA, 19 nt, Homo sapiens
caauauuuucagaugcucc

SEQ ID NO: 1184 - RNA, 19 nt, Homo sapiens
cuugaaucacaauauuuuc

SEQ ID NO: 1185 - RNA, 19 nt, Homo sapiens
guauccauaaacuugaauc

SEQ ID NO: 1186 - RNA, 19 nt, Homo sapiens
caaaugcuucaguguaucc

SEQ ID NO: 1187 - RNA, 19 nt, Homo sapiens
uuguugcaucaaaugcuuc

SEQ ID NO: 1188 - RNA, 19 nt, Homo sapiens
uuuaauagagauuguugca

SEQ ID NO: 1189 - RNA, 19 nt, Homo sapiens
auaacuuuuaauagagauu

SEQ ID NO: 1190 - RNA, 19 nt, Homo sapiens
uuuuuuaucaggauaacuu

SEQ ID NO: 1191 - RNA, 19 nt, Homo sapiens
uaacuaaauuuuuuaucag

SEQ ID NO: 1192 - RNA, 19 nt, Homo sapiens
uggccugaggaguaacuaa

SEQ ID NO: 1193 - RNA, 19 nt, Homo sapiens
aaaugaacauggccugagg

SEQ ID NO: 1194 - RNA, 19 nt, Homo sapiens
uucucugaggauaaaugaa

SEQ ID NO: 1195 - RNA, 19 nt, Homo sapiens
uuggaauuuauucucugag

SEQ ID NO: 1196 - RNA, 19 nt, Homo sapiens
cagaguuuuggaauuuauu

SEQ ID NO: 1197 - RNA, 19 nt, Homo sapiens
uauuguuaagauugcagag

SEQ ID NO: 1198 - RNA, 19 nt, Homo sapiens
uuuugguuguauuguuaag

SEQ ID NO: 1199 - RNA, 19 nt, Homo sapiens
caggcaauuguuuugguug

SEQ ID NO: 1200 - RNA, 19 nt, Homo sapiens
uuuguccuccaggcaauug

SEQ ID NO: 1201 - RNA, 19 nt, Homo sapiens
aagaaacuggguuuugucc

SEQ ID NO: 1202 - RNA, 19 nt, Homo sapiens
aauacacauaagaaacugg

SEQ ID NO: 1203 - RNA, 19 nt, Homo sapiens
acaacuuccaaauacacau

SEQ ID NO: 1204 - RNA, 19 nt, Homo sapiens
augcuuugauacaacuucc

SEQ ID NO: 1205 - RNA, 19 nt, Homo sapiens
uugaaaaaugcuuugauac

SEQ ID NO: 1206 - RNA, 19 nt, Homo sapiens
uucuuuuugauuuugaaaa

SEQ ID NO: 1207 - RNA, 19 nt, Homo sapiens
guuauuggcauucuuuuug

SEQ ID NO: 1208 - RNA, 19 nt, Homo sapiens
auugucauagguuauuggc

SEQ ID NO: 1209 - RNA, 19 nt, Homo sapiens
agaaauccauugucauagg

SEQ ID NO: 1210 - RNA, 19 nt, Homo sapiens
augaaugaagagaaaucca

SEQ ID NO: 1211 - RNA, 19 nt, Homo sapiens
agguuugucuguaugaaug

SEQ ID NO: 1212 - RNA, 19 nt, Homo sapiens
guauaaacagguuugucug

SEQ ID NO: 1213 - RNA, 19 nt, Homo sapiens
acuggucuggaguauaaac

SEQ ID NO: 1214 - RNA, 19 nt, Homo sapiens
aacuuuuacugacuggucu

SEQ ID NO: 1215 - RNA, 19 nt, Homo sapiens
auaaacucuaacuuuuacu

SEQ ID NO: 1216 - RNA, 19 nt, Homo sapiens
cauucaacgaauaaacucu

SEQ ID NO: 1217 - RNA, 19 nt, Homo sapiens
uucaagucgucauucaacg

SEQ ID NO: 1218 - RNA, 19 nt, Homo sapiens
ucuuuuggcuggcuucaag

SEQ ID NO: 1219 - RNA, 19 nt, Homo sapiens
caguuucucuuuuggcugg

SEQ ID NO: 1220 - RNA, 19 nt, Homo sapiens
augaaaguuaagacaguuu

SEQ ID NO: 1221 - RNA, 19 nt, Homo sapiens
uucaggaucuaugaaaguu

SEQ ID NO: 1222 - RNA, 19 nt, Homo sapiens
ugauccuucaggaucuaug

SEQ ID NO: 1223 - RNA, 19 nt, Homo sapiens
ugucaacuucugauccuuc

SEQ ID NO: 1224 - RNA, 19 nt, Homo sapiens
aauuucuucuaccauguca

SEQ ID NO: 1225 - RNA, 19 nt, Homo sapiens
caauaugaucaauuucuuc

SEQ ID NO: 1226 - RNA, 19 nt, Homo sapiens
agauaauuccaauaugauc

SEQ ID NO: 1227 - RNA, 19 nt, Homo sapiens
caggaaaagagauaauucc

SEQ ID NO: 1228 - RNA, 19 nt, Homo sapiens
cuugaagucaggaaaagag

SEQ ID NO: 1229 - RNA, 19 nt, Homo sapiens
uuagacggaaucuugaagu

SEQ ID NO: 1230 - RNA, 19 nt, Homo sapiens
cauaucuaggauuagacgg

SEQ ID NO: 1231 - RNA, 19 nt, Homo sapiens
uccacauaccauaucuagg

SEQ ID NO: 1232 - RNA, 19 nt, Homo sapiens
uuagccuugaucguccaca

SEQ ID NO: 1233 - RNA, 19 nt, Homo sapiens
uuauauuuagccuugaucg

SEQ ID NO: 1234 - RNA, 19 nt, Homo sapiens
ugaaaaguccucuuuauau

SEQ ID NO: 1235 - RNA, 19 nt, Homo sapiens
caguuguugaaaaguccuc

SEQ ID NO: 1236 - RNA, 19 nt, Homo sapiens
aaauaugcgguuccaguug

SEQ ID NO: 1237 - RNA, 19 nt, Homo sapiens
uuuaacuucaaaauaugcg

SEQ ID NO: 1238 - RNA, 19 nt, Homo sapiens
aagacauauucuuuaacuu

SEQ ID NO: 1239 - RNA, 19 nt, Homo sapiens
aauguggcaagacauauuc

SEQ ID NO: 1240 - RNA, 19 nt, Homo sapiens
uugagacagaaaaaugugg

SEQ ID NO: 1241 - RNA, 19 nt, Homo sapiens
ucuggcucgauugagacag

SEQ ID NO: 1242 - RNA, 19 nt, Homo sapiens
uuauauucuggcucgauug

SEQ ID NO: 1243 - RNA, 19 nt, Homo sapiens
aaccaaugaaauuauauuc

SEQ ID NO: 1244 - RNA, 19 nt, Homo sapiens
uaaaguucuuguaaccaau

SEQ ID NO: 1245 - RNA, 19 nt, Homo sapiens
ucaaaauucuuaaaguucu

SEQ ID NO: 1246 - RNA, 19 nt, Homo sapiens
uauaguaauuucaaaauuc

SEQ ID NO: 1247 - RNA, 19 nt, Homo sapiens
uugcuuuuauaguaauuuc

SEQ ID NO: 1248 - RNA, 19 nt, Homo sapiens
uauaaaaauaucuugcuuu

SEQ ID NO: 1249 - RNA, 19 nt, Homo sapiens
uacuuuauuauaaaaauau

SEQ ID NO: 1250 - RNA, 19 nt, Homo sapiens
ucagccucagugacuacuu

SEQ ID NO: 1251 - RNA, 19 nt, Homo sapiens
auaaacgucagccucagug

SEQ ID NO: 1252 - RNA, 19 nt, Homo sapiens
uccaaaugugauauaaacg

SEQ ID NO: 1253 - RNA, 19 nt, Homo sapiens
uucucuuauuccaaaugug

SEQ ID NO: 1254 - RNA, 19 nt, Homo sapiens
uuuuaagucuucucuuauu

SEQ ID NO: 1255 - RNA, 19 nt, Homo sapiens
uuuuugaucaucuuuuaag

SEQ ID NO: 1256 - RNA, 19 nt, Homo sapiens
ucauuucuuuuugaucauc

SEQ ID NO: 1257 - RNA, 19 nt, Homo sapiens
auugcuguuugcaucauuu

SEQ ID NO: 1258 - RNA, 19 nt, Homo sapiens
uuguguuuugcauugcugu

SEQ ID NO: 1259 - RNA, 19 nt, Homo sapiens
uuuaucaacauuguguuuu

SEQ ID NO: 1260 - RNA, 19 nt, Homo sapiens
auuccauuuaucaacauug

SEQ ID NO: 1261 - RNA, 19 nt, Homo sapiens
augugacuugagcaauucc

SEQ ID NO: 1262 - RNA, 19 nt, Homo sapiens
aaucaaaugugacuugagc

SEQ ID NO: 1263 - RNA, 19 nt, Homo sapiens
ugcuguuucagaaucaaau

SEQ ID NO: 1264 - RNA, 19 nt, Homo sapiens
uucuuugacugcuguuuca

SEQ ID NO: 1265 - RNA, 19 nt, Homo sapiens
guaguaugacaguucuuug

SEQ ID NO: 1266 - RNA, 19 nt, Homo sapiens
ucuucuaaacuguaguaug

SEQ ID NO: 1267 - RNA, 19 nt, Homo sapiens
guuuaaaucuucuaaacug

SEQ ID NO: 1268 - RNA, 19 nt, Homo sapiens
uaaagguacuuguuguuua

SEQ ID NO: 1269 - RNA, 19 nt, Homo sapiens
agcaauauaaagguacuug

SEQ ID NO: 1270 - RNA, 19 nt, Homo sapiens
uaugacuguuacagcaaua

SEQ ID NO: 1271 - RNA, 19 nt, Homo sapiens
uguagacucuaugacuguu

SEQ ID NO: 1272 - RNA, 19 nt, Homo sapiens
aaauccaccuguagacucu

SEQ ID NO: 1273 - RNA, 19 nt, Homo sapiens
cugccucuucagaaaaucc

SEQ ID NO: 1274 - RNA, 19 nt, Homo sapiens
cagguauuucugccucuuc

SEQ ID NO: 1275 - RNA, 19 nt, Homo sapiens
uuugaugccagguauuucu

SEQ ID NO: 1276 - RNA, 19 nt, Homo sapiens
gagaggacauauuugaugc

SEQ ID NO: 1277 - RNA, 19 nt, Homo sapiens
uuuguagggagagaggaca

SEQ ID NO: 1278 - RNA, 19 nt, Homo sapiens
aggaguagcaaccaaauuc

SEQ ID NO: 1279 - RNA, 19 nt, Homo sapiens
ucaggaaaagaggaguagc

SEQ ID NO: 1280 - RNA, 19 nt, Homo sapiens
ccaggcuucaggaaaagag

SEQ ID NO: 1281 - RNA, 19 nt, Homo sapiens
ugggauauggaaucccagg

SEQ ID NO: 1282 - RNA, 19 nt, Homo sapiens
ugcaccuugaugggauaug

SEQ ID NO: 1283 - RNA, 19 nt, Homo sapiens
uuaaccugcaccuugaugg

SEQ ID NO: 1284 - RNA, 19 nt, Homo sapiens
caagcgaaucuuuaaccug

SEQ ID NO: 1285 - RNA, 19 nt, Homo sapiens
uaccaacuggucaagcgaa

SEQ ID NO: 1286 - RNA, 19 nt, Homo sapiens
gacuccuccuaccaacugg

SEQ ID NO: 1287 - RNA, 19 nt, Homo sapiens
guguuacugggacuccucc

SEQ ID NO: 1288 - RNA, 19 nt, Homo sapiens
ugugcauucaguguuacug

SEQ ID NO: 1289 - RNA, 19 nt, Homo sapiens
aucaauuguuugugcauuc

SEQ ID NO: 1290 - RNA, 19 nt, Homo sapiens
uugguuuacaucaauuguu

SEQ ID NO: 1291 - RNA, 19 nt, Homo sapiens
ucagaugucucuugguuua

SEQ ID NO: 1292 - RNA, 19 nt, Homo sapiens
cuuggauccaagucagaug

SEQ ID NO: 1293 - RNA, 19 nt, Homo sapiens
uuacacuuuugcuuggauc

SEQ ID NO: 1294 - RNA, 19 nt, Homo sapiens
aacacguguuacacuuuug

SEQ ID NO: 1295 - RNA, 19 nt, Homo sapiens
uccaucaucaacacguguu

SEQ ID NO: 1296 - RNA, 19 nt, Homo sapiens
aaaggaagcuacuccauca

SEQ ID NO: 1297 - RNA, 19 nt, Homo sapiens
uaagcacaaaggaagcuac

SEQ ID NO: 1298 - RNA, 19 nt, Homo sapiens
uccagaugggagauuaagc

SEQ ID NO: 1299 - RNA, 19 nt, Homo sapiens
gcaccgucacuccagaugg

SEQ ID NO: 1300 - RNA, 19 nt, Homo sapiens
uuaaacuccagcaccguca

SEQ ID NO: 1301 - RNA, 19 nt, Homo sapiens
uuugacauuaaacuccagc

SEQ ID NO: 1302 - RNA, 19 nt, Homo sapiens
uggagcaucaguuuugaca

SEQ ID NO: 1303 - RNA, 19 nt, Homo sapiens
cuggaagaucuggagcauc

SEQ ID NO: 1304 - RNA, 19 nt, Homo sapiens
uuuucuucuggaagaucug

SEQ ID NO: 1305 - RNA, 19 nt, Homo sapiens
uucccuggccugauuuucu

SEQ ID NO: 1306 - RNA, 19 nt, Homo sapiens
ucgguaaccuucccuggcc

SEQ ID NO: 1307 - RNA, 19 nt, Homo sapiens
uaugcuauugcucgguaac

SEQ ID NO: 1308 - RNA, 19 nt, Homo sapiens
ugagagaugaguaugcuau

SEQ ID NO: 1309 - RNA, 19 nt, Homo sapiens
uuuggcugagagaugagua

SEQ ID NO: 1310 - RNA, 19 nt, Homo sapiens
auauaaagguaacuuuggc

SEQ ID NO: 1311 - RNA, 19 nt, Homo sapiens
aguccaaucaauauaaagg

SEQ ID NO: 1312 - RNA, 19 nt, Homo sapiens
uaugguuaucaguccaauc

SEQ ID NO: 1313 - RNA, 19 nt, Homo sapiens
aaagccuuaugguuaucag

SEQ ID NO: 1314 - RNA, 19 nt, Homo sapiens
ucucccacuagcaaagccu

SEQ ID NO: 1315 - RNA, 19 nt, Homo sapiens
uauucagauguucucccac

SEQ ID NO: 1316 - RNA, 19 nt, Homo sapiens
uaacaauaauauucagaug

SEQ ID NO: 1317 - RNA, 19 nt, Homo sapiens
uuuggggguaacaauaaua

SEQ ID NO: 1318 - RNA, 19 nt, Homo sapiens
caauauaugggcuuuuggg

SEQ ID NO: 1319 - RNA, 19 nt, Homo sapiens
ucaauauaugggcuuuugg

SEQ ID NO: 1320 - RNA, 19 nt, Homo sapiens
gucaauauaugggcuuuug

SEQ ID NO: 1321 - RNA, 19 nt, Homo sapiens
ugucaauauaugggcuuuu

SEQ ID NO: 1322 - RNA, 19 nt, Homo sapiens
uugucaauauaugggcuuu

SEQ ID NO: 1323 - RNA, 19 nt, Homo sapiens
uuugucaauauaugggcuu

SEQ ID NO: 1324 - RNA, 19 nt, Homo sapiens
uuuugucaauauaugggcu

SEQ ID NO: 1325 - RNA, 19 nt, Homo sapiens
auuuugucaauauaugggc

SEQ ID NO: 1326 - RNA, 19 nt, Homo sapiens
uauuuugucaauauauggg

SEQ ID NO: 1327 - RNA, 19 nt, Homo sapiens
uuauuuugucaauauaugg

SEQ ID NO: 1328 - RNA, 19 nt, Homo sapiens
guuauuuugucaauauaug

SEQ ID NO: 1329 - RNA, 19 nt, Homo sapiens
aguuauuuugucaauauau

SEQ ID NO: 1330 - RNA, 19 nt, Homo sapiens
gaguuauuuugucaauaua

SEQ ID NO: 1331 - RNA, 19 nt, Homo sapiens
ugaguuauuuugucaauau

SEQ ID NO: 1332 - RNA, 19 nt, Homo sapiens
gugaguuauuuugucaaua

SEQ ID NO: 1333 - RNA, 19 nt, Homo sapiens
agugaguuauuuugucaau

SEQ ID NO: 1334 - RNA, 19 nt, Homo sapiens
uagugaguuauuuugucaa

SEQ ID NO: 1335 - RNA, 19 nt, Homo sapiens
auagugaguuauuuuguca

SEQ ID NO: 1336 - RNA, 19 nt, Homo sapiens
uauagugaguuauuuuguc

SEQ ID NO: 1337 - RNA, 19 nt, Homo sapiens
aauuauagugaguuauuuu

SEQ ID NO: 1338 - RNA, 19 nt, Homo sapiens
uaauuauagugaguuauuu

SEQ ID NO: 1339 - RNA, 19 nt, Homo sapiens
guaauuauagugaguuauu

SEQ ID NO: 1340 - RNA, 19 nt, Homo sapiens
aguaauuauagugaguuau

SEQ ID NO: 1341 - RNA, 19 nt, Homo sapiens
caaguaauuauagugaguu

SEQ ID NO: 1342 - RNA, 19 nt, Homo sapiens
ucaaguaauuauagugagu

SEQ ID NO: 1343 - RNA, 19 nt, Homo sapiens
aucaaguaauuauagugag

SEQ ID NO: 1344 - RNA, 19 nt, Homo sapiens
aaucaaguaauuauaguga

SEQ ID NO: 1345 - RNA, 19 nt, Homo sapiens
aaaaucaaguaauuauagu

SEQ ID NO: 1346 - RNA, 19 nt, Homo sapiens
uaaaaucaaguaauuauag

SEQ ID NO: 1347 - RNA, 19 nt, Homo sapiens
auaaaaucaaguaauuaua

SEQ ID NO: 1348 - RNA, 19 nt, Homo sapiens
gauaaaaucaaguaauuau

SEQ ID NO: 1349 - RNA, 19 nt, Homo sapiens
ggauaaaaucaaguaauua

SEQ ID NO: 1350 - RNA, 19 nt, Homo sapiens
uggauaaaaucaaguaauu

SEQ ID NO: 1351 - RNA, 19 nt, Homo sapiens
uuggauaaaaucaaguaau

SEQ ID NO: 1352 - RNA, 19 nt, Homo sapiens
uaauuuugcccuuggauaa

SEQ ID NO: 1353 - RNA, 19 nt, Homo sapiens
ccaaaguggauaauuuugc

SEQ ID NO: 1354 - RNA, 19 nt, Homo sapiens
ucucccucgugccaaagug

SEQ ID NO: 1355 - RNA, 19 nt, Homo sapiens
ucugaaaauuucucccucg

SEQ ID NO: 1356 - RNA, 19 nt, Homo sapiens
auaagaugcaucugaaaau

SEQ ID NO: 1357 - RNA, 19 nt, Homo sapiens
uuauacuuugauaagaugc

SEQ ID NO: 1358 - RNA, 19 nt, Homo sapiens
cuggaauguuuauacuuug

SEQ ID NO: 1359 - RNA, 19 nt, Homo sapiens
uguucuguguuacuggaau

SEQ ID NO: 1360 - RNA, 19 nt, Homo sapiens
gaaggaaccauguucugug

SEQ ID NO: 1361 - RNA, 19 nt, Homo sapiens
aagucgggaugaaggaacc

SEQ ID NO: 1362 - RNA, 19 nt, Homo sapiens
uaauagaccagaagucggg

SEQ ID NO: 1363 - RNA, 19 nt, Homo sapiens
ugugacgauguaauagacc

SEQ ID NO: 1364 - RNA, 19 nt, Homo sapiens
ucuguucuccugugacgau

SEQ ID NO: 1365 - RNA, 19 nt, Homo sapiens
ucugcugucuguucuccug

SEQ ID NO: 1366 - RNA, 19 nt, Homo sapiens
ucagacacuaauucugcug

SEQ ID NO: 1367 - RNA, 19 nt, Homo sapiens
accagacugaaucagacac

SEQ ID NO: 1368 - RNA, 19 nt, Homo sapiens
ucaauauuuaaccagacug

SEQ ID NO: 1369 - RNA, 19 nt, Homo sapiens
uuuuucuucaauauuuaac

SEQ ID NO: 1370 - RNA, 19 nt, Homo sapiens
cugguugccacauuuuucu

SEQ ID NO: 1371 - RNA, 19 nt, Homo sapiens
ugaaccuggagcugguugc

SEQ ID NO: 1372 - RNA, 19 nt, Homo sapiens
agacagaugaaccuggagc

SEQ ID NO: 1373 - RNA, 19 nt, Homo sapiens
ucugcaucaggagacagau

SEQ ID NO: 1374 - RNA, 19 nt, Homo sapiens
gagaauaugcaucugcauc

SEQ ID NO: 1375 - RNA, 19 nt, Homo sapiens
uuuggccuggagaauaugc

SEQ ID NO: 1376 - RNA, 19 nt, Homo sapiens
aagagacacaguuuggccu

SEQ ID NO: 1377 - RNA, 19 nt, Homo sapiens
uugccauauuaagagacac

SEQ ID NO: 1378 - RNA, 19 nt, Homo sapiens
auuccaguugccauauuaa

SEQ ID NO: 1379 - RNA, 19 nt, Homo sapiens
ccaggaauccauuccaguu

SEQ ID NO: 1380 - RNA, 19 nt, Homo sapiens
ugcuaaugccacccaggaa

SEQ ID NO: 1381 - RNA, 19 nt, Homo sapiens
guccacugcugcuaaugcc

SEQ ID NO: 1382 - RNA, 19 nt, Homo sapiens
auacacagcacuguccacu

SEQ ID NO: 1383 - RNA, 19 nt, Homo sapiens
uuuggacuccauacacagc

SEQ ID NO: 1384 - RNA, 19 nt, Homo sapiens
uuuggcuccucuuuggacu

SEQ ID NO: 1385 - RNA, 19 nt, Homo sapiens
agggcuuuuuggcuccucu

SEQ ID NO: 1386 - RNA, 19 nt, Homo sapiens
aauacucuuuccaagggcu

SEQ ID NO: 1387 - RNA, 19 nt, Homo sapiens
uaagaauugaaauacucuu

SEQ ID NO: 1388 - RNA, 19 nt, Homo sapiens
ucuucucuaagaauugaaa

SEQ ID NO: 1389 - RNA, 19 nt, Homo sapiens
agcccagaucacucuucuc

SEQ ID NO: 1390 - RNA, 19 nt, Homo sapiens
ugccccacagcccagauca

SEQ ID NO: 1391 - RNA, 19 nt, Homo sapiens
ugaggccaccaccugcccc

SEQ ID NO: 1392 - RNA, 19 nt, Homo sapiens
uuggcauuguugaggccac

SEQ ID NO: 1393 - RNA, 19 nt, Homo sapiens
gaacacauuggcauuguug

SEQ ID NO: 1394 - RNA, 19 nt, Homo sapiens
agcuagguggaacacauug

SEQ ID NO: 1395 - RNA, 19 nt, Homo sapiens
agguaaguccagcuaggug

SEQ ID NO: 1396 - RNA, 19 nt, Homo sapiens
uuagugaggaagguaaguc

SEQ ID NO: 1397 - RNA, 19 nt, Homo sapiens
ucugcauuugcauuaguga

SEQ ID NO: 1398 - RNA, 19 nt, Homo sapiens
uugggagucaucugcauuu

SEQ ID NO: 1399 - RNA, 19 nt, Homo sapiens
uucaucauuuucuugggag

SEQ ID NO: 1400 - RNA, 19 nt, Homo sapiens
ugagaauuucuuuacaagg

SEQ ID NO: 1401 - RNA, 19 nt, Homo sapiens
ucuucuuggccugagaauu

SEQ ID NO: 1402 - RNA, 19 nt, Homo sapiens
uuugcagcguucuucuugg

SEQ ID NO: 1403 - RNA, 19 nt, Homo sapiens
ucuaucuucuuuugcagcg

SEQ ID NO: 1404 - RNA, 19 nt, Homo sapiens
uauuucuucuaucuucuuu

SEQ ID NO: 1405 - RNA, 19 nt, Homo sapiens
auauuuagcagcuauuucu

SEQ ID NO: 1406 - RNA, 19 nt, Homo sapiens
aauguuuauauuuagcagc

SEQ ID NO: 1407 - RNA, 19 nt, Homo sapiens
uuucuucacuacugaaugu

SEQ ID NO: 1408 - RNA, 19 nt, Homo sapiens
aacaacauuucuucacuac

SEQ ID NO: 1409 - RNA, 19 nt, Homo sapiens
cuccaucguaacaacauuu

SEQ ID NO: 1410 - RNA, 19 nt, Homo sapiens
auuaacgcaggcuccaucg

SEQ ID NO: 1411 - RNA, 19 nt, Homo sapiens
gguuucaucauuauuaacg

SEQ ID NO: 1412 - RNA, 19 nt, Homo sapiens
ugcucacagguuucaucau

SEQ ID NO: 1413 - RNA, 19 nt, Homo sapiens
ugcagcucgcugcucacag

SEQ ID NO: 1414 - RNA, 19 nt, Homo sapiens
aacuaauccgugcagcucg

SEQ ID NO: 1415 - RNA, 19 nt, Homo sapiens
cuuggcccuaaacuaaucc

SEQ ID NO: 1416 - RNA, 19 nt, Homo sapiens
cuuugaugcaucuuggccc

SEQ ID NO: 1417 - RNA, 19 nt, Homo sapiens
uucagugaaagcuuugaug

SEQ ID NO: 1418 - RNA, 19 nt, Homo sapiens
cacaacauucagugaaagc

SEQ ID NO: 1419 - RNA, 19 nt, Homo sapiens
cuugcgacgacacaacauu

SEQ ID NO: 1420 - RNA, 19 nt, Homo sapiens
acggagcuggcuugcgacg

SEQ ID NO: 1421 - RNA, 19 nt, Homo sapiens
agagauauuagcacggagc

SEQ ID NO: 1422 - RNA, 19 nt, Homo sapiens
ucuuuaugagagauauuag

SEQ ID NO: 1423 - RNA, 19 nt, Homo sapiens
uucccaauugcaugucuuu

SEQ ID NO: 1424 - RNA, 19 nt, Homo sapiens
uguguagccuucccaauug

SEQ ID NO: 1425 - RNA, 19 nt, Homo sapiens
cagggucuucauguguagc

SEQ ID NO: 1426 - RNA, 19 nt, Homo sapiens
ugguaacagggucuucaug

SEQ ID NO: 1427 - RNA, 19 nt, Homo sapiens
ucuggcuugcuuacuggua

SEQ ID NO: 1428 - RNA, 19 nt, Homo sapiens
uccgaauuucuggcuugcu

SEQ ID NO: 1429 - RNA, 19 nt, Homo sapiens
aaaauaacuccgaauuucu

SEQ ID NO: 1430 - RNA, 19 nt, Homo sapiens
agcuuucuggaaaauaacu

SEQ ID NO: 1431 - RNA, 19 nt, Homo sapiens
ucccacaaccagcuuucug

SEQ ID NO: 1432 - RNA, 19 nt, Homo sapiens
aacaagaugaacuucccac

SEQ ID NO: 1433 - RNA, 19 nt, Homo sapiens
ucuucugggaacaagauga

SEQ ID NO: 1434 - RNA, 19 nt, Homo sapiens
ugcaacuguuuucuucugg

SEQ ID NO: 1435 - RNA, 19 nt, Homo sapiens
guagggcaaacugcaacug

SEQ ID NO: 1436 - RNA, 19 nt, Homo sapiens
aaucagguagggcaaacug

SEQ ID NO: 1437 - RNA, 19 nt, Homo sapiens
aggugguuagagaaucagg

SEQ ID NO: 1438 - RNA, 19 nt, Homo sapiens
cuugaauuucccagguggu

SEQ ID NO: 1439 - RNA, 19 nt, Homo sapiens
ugccaacgccuugaauuuc

SEQ ID NO: 1440 - RNA, 19 nt, Homo sapiens
aguguuugaaaugccaacg

SEQ ID NO: 1441 - RNA, 19 nt, Homo sapiens
uauaccaguguuugaaaug

SEQ ID NO: 1442 - RNA, 19 nt, Homo sapiens
guaucagcaacacauauac

SEQ ID NO: 1443 - RNA, 19 nt, Homo sapiens
ugccuugacaguaucagca

SEQ ID NO: 1444 - RNA, 19 nt, Homo sapiens
aacaccuuugccuugacag

SEQ ID NO: 1445 - RNA, 19 nt, Homo sapiens
aagacaucuuugaacaccu

SEQ ID NO: 1446 - RNA, 19 nt, Homo sapiens
uuccaggaagacaucuuug

SEQ ID NO: 1447 - RNA, 19 nt, Homo sapiens
uauauucauuuccaggaag

SEQ ID NO: 1448 - RNA, 19 nt, Homo sapiens
aacagaauaugguauauuc

SEQ ID NO: 1449 - RNA, 19 nt, Homo sapiens
uccucguacaacagaauau

SEQ ID NO: 1450 - RNA, 19 nt, Homo sapiens
auuggaucuguucuccucg

SEQ ID NO: 1451 - RNA, 19 nt, Homo sapiens
cuuucaauuggaucuguuc

SEQ ID NO: 1452 - RNA, 19 nt, Homo sapiens
guuguaaacaguuccuuuc

SEQ ID NO: 1453 - RNA, 19 nt, Homo sapiens
uccuauaguuguaaacagu

SEQ ID NO: 1454 - RNA, 19 nt, Homo sapiens
ucccagaaguccuauaguu

SEQ ID NO: 1455 - RNA, 19 nt, Homo sapiens
aacacagaacugcauccca

SEQ ID NO: 1456 - RNA, 19 nt, Homo sapiens
agacauuuuaacacagaac

SEQ ID NO: 1457 - RNA, 19 nt, Homo sapiens
uccacagcagacauuuuaa

SEQ ID NO: 1458 - RNA, 19 nt, Homo sapiens
gugcagauucccuccacag

SEQ ID NO: 1459 - RNA, 19 nt, Homo sapiens
uuuccgaagugcagauucc

SEQ ID NO: 1460 - RNA, 19 nt, Homo sapiens
ucaaugacugggcuuuccg

SEQ ID NO: 1461 - RNA, 19 nt, Homo sapiens
ccugaugaucaaugacugg

SEQ ID NO: 1462 - RNA, 19 nt, Homo sapiens
aggacuuugugcccugaug

SEQ ID NO: 1463 - RNA, 19 nt, Homo sapiens
auuuggaggacuuugugcc

SEQ ID NO: 1464 - RNA, 19 nt, Homo sapiens
uuucuggcgcacacauuug

SEQ ID NO: 1465 - RNA, 19 nt, Homo sapiens
gcccucuacuuucuggcgc

SEQ ID NO: 1466 - RNA, 19 nt, Homo sapiens
acuggaggagcccucuacu

SEQ ID NO: 1467 - RNA, 19 nt, Homo sapiens
gucaccaagugacuggagg

SEQ ID NO: 1468 - RNA, 19 nt, Homo sapiens
agugaaugucaccaaguga

SEQ ID NO: 1469 - RNA, 19 nt, Homo sapiens
agaggaagcacagugaaug

SEQ ID NO: 1470 - RNA, 19 nt, Homo sapiens
guugugaaggccaauuucc

SEQ ID NO: 1471 - RNA, 19 nt, Homo sapiens
aaaaauugauguugugaag

SEQ ID NO: 1472 - RNA, 19 nt, Homo sapiens
aagucuccagugaaaaauu

SEQ ID NO: 1473 - RNA, 19 nt, Homo sapiens
uuccaaaccaagucuccag

SEQ ID NO: 1474 - RNA, 19 nt, Homo sapiens
aagauuucuuuuccaaacc

SEQ ID NO: 1475 - RNA, 19 nt, Homo sapiens
uaauguuuuuacuaagauu

SEQ ID NO: 1476 - RNA, 19 nt, Homo sapiens
caccacucguaauguuuuu

SEQ ID NO: 1477 - RNA, 19 nt, Homo sapiens
acaccuucuggcaccacuc

SEQ ID NO: 1478 - RNA, 19 nt, Homo sapiens
uucccuuuugacaccuucu

SEQ ID NO: 1479 - RNA, 19 nt, Homo sapiens
auagcuuucccuuuugaca

SEQ ID NO: 1480 - RNA, 19 nt, Homo sapiens
aaaguaacaccagaauagc

SEQ ID NO: 1481 - RNA, 19 nt, Homo sapiens
cuaggauccaaaguaacac

SEQ ID NO: 1482 - RNA, 19 nt, Homo sapiens
auaaauaccccuaggaucc

SEQ ID NO: 1483 - RNA, 19 nt, Homo sapiens
uaaugguaccauaaauacc

SEQ ID NO: 1484 - RNA, 19 nt, Homo sapiens
uuucgucugcuaaugguac

SEQ ID NO: 1485 - RNA, 19 nt, Homo sapiens
ugggaacuccuuucgucug

SEQ ID NO: 1486 - RNA, 19 nt, Homo sapiens
auccuguaugggaacuccu

SEQ ID NO: 1487 - RNA, 19 nt, Homo sapiens
ucuaaggguauccuguaug

SEQ ID NO: 1488 - RNA, 19 nt, Homo sapiens
uuuggggaccaaaucuaag

SEQ ID NO: 1489 - RNA, 19 nt, Homo sapiens
uugauuucuguuuugggga

SEQ ID NO: 1490 - RNA, 19 nt, Homo sapiens
aaauccuuuugauuucugu

SEQ ID NO: 1491 - RNA, 19 nt, Homo sapiens
uuuacacucaaaauccuuu

SEQ ID NO: 1492 - RNA, 19 nt, Homo sapiens
caagcaguccuuuuacacu

SEQ ID NO: 1493 - RNA, 19 nt, Homo sapiens
ucaccuacaagcaguccuu

SEQ ID NO: 1494 - RNA, 19 nt, Homo sapiens
cagacaagaucucaccuac

SEQ ID NO: 1495 - RNA, 19 nt, Homo sapiens
uuagaacugcagacaagau

SEQ ID NO: 1496 - RNA, 19 nt, Homo sapiens
ugccuuccugacuuagaac

SEQ ID NO: 1497 - RNA, 19 nt, Homo sapiens
uuaggauauugaugccuuc

SEQ ID NO: 1498 - RNA, 19 nt, Homo sapiens
agguggguuaggauauuga

SEQ ID NO: 1499 - RNA, 19 nt, Homo sapiens
acucccuuuggggaggugg

SEQ ID NO: 1500 - RNA, 19 nt, Homo sapiens
cucugcacucccuuugggg

SEQ ID NO: 1501 - RNA, 19 nt, Homo sapiens
aucagcuccgccucugcac

SEQ ID NO: 1502 - RNA, 19 nt, Homo sapiens
gacaacgcucaucagcucc

SEQ ID NO: 1503 - RNA, 19 nt, Homo sapiens
auagaauacugggacaacg

SEQ ID NO: 1504 - RNA, 19 nt, Homo sapiens
gaaaaacauagaauacugg

SEQ ID NO: 1505 - RNA, 19 nt, Homo sapiens
uuuccagguagugaaaaac

SEQ ID NO: 1506 - RNA, 19 nt, Homo sapiens
augauuuccuguuuccagg

SEQ ID NO: 1507 - RNA, 19 nt, Homo sapiens
ucagaaugaaaaauguucc

SEQ ID NO: 1508 - RNA, 19 nt, Homo sapiens
caauuaaugggucagaaug

SEQ ID NO: 1509 - RNA, 19 nt, Homo sapiens
ucugcuuuucaauuaaugg

SEQ ID NO: 1510 - RNA, 19 nt, Homo sapiens
uuucuucaguuucugcuuu

SEQ ID NO: 1511 - RNA, 19 nt, Homo sapiens
uuuaauuuuuucuucaguu

SEQ ID NO: 1512 - RNA, 19 nt, Homo sapiens
ucccuucuuuuaauuuuuu

SEQ ID NO: 1513 - RNA, 19 nt, Homo sapiens
cauaaugcucaacaucccu

SEQ ID NO: 1514 - RNA, 19 nt, Homo sapiens
ucuguaggacauaaugcuc

SEQ ID NO: 1515 - RNA, 19 nt, Homo sapiens
ucagcauuucuguaggaca

SEQ ID NO: 1516 - RNA, 19 nt, Homo sapiens
uguaagaguagucagcauu

SEQ ID NO: 1517 - RNA, 19 nt, Homo sapiens
uccacacacuguaagagua

SEQ ID NO: 1518 - RNA, 19 nt, Homo sapiens
uuccacccuuccacacacu

SEQ ID NO: 1519 - RNA, 19 nt, Homo sapiens
agugcuagcacuuccaccc

SEQ ID NO: 1520 - RNA, 19 nt, Homo sapiens
cuguuaaccaagugcuagc

SEQ ID NO: 1521 - RNA, 19 nt, Homo sapiens
aaagcaaaagcuguuaacc

SEQ ID NO: 1522 - RNA, 19 nt, Homo sapiens
uccaaguacucuuaaagca

SEQ ID NO: 1523 - RNA, 19 nt, Homo sapiens
uauuuacuuguccaaguac

SEQ ID NO: 1524 - RNA, 19 nt, Homo sapiens
cuacguauuuauuuacuug

SEQ ID NO: 1525 - RNA, 19 nt, Homo sapiens
uucugcucuacguauuuau

SEQ ID NO: 1526 - RNA, 19 nt, Homo sapiens
uugaauuuugguucugcuc

SEQ ID NO: 1527 - RNA, 19 nt, Homo sapiens
aagaauuacaaauugaauu

SEQ ID NO: 1528 - RNA, 19 nt, Homo sapiens
agccacaauaaagaauuac

SEQ ID NO: 1529 - RNA, 19 nt, Homo sapiens
auucucaacuagccacaau

SEQ ID NO: 1530 - RNA, 19 nt, Homo sapiens
auugauaauucucaacuag

SEQ ID NO: 1531 - RNA, 19 nt, Homo sapiens
uccauuaucuaauugauaa

SEQ ID NO: 1532 - RNA, 19 nt, Homo sapiens
uuuccuugaaagauccauu

SEQ ID NO: 1533 - RNA, 19 nt, Homo sapiens
ugugaauuuuccuugaaag

SEQ ID NO: 1534 - RNA, 19 nt, Homo sapiens
uugguugauacugugaauu

SEQ ID NO: 1535 - RNA, 19 nt, Homo sapiens
uaauuuuauugguugauac

SEQ ID NO: 1536 - RNA, 19 nt, Homo sapiens
caagguacccuguaauuuu

SEQ ID NO: 1537 - RNA, 19 nt, Homo sapiens
ucaacaggcaagguacccu

SEQ ID NO: 1538 - RNA, 19 nt, Homo sapiens
uguucucucgggcuucaac

SEQ ID NO: 1539 - RNA, 19 nt, Homo sapiens
auauaagcuguucucucgg

SEQ ID NO: 1540 - RNA, 19 nt, Homo sapiens
aaggcuguaagauauaagc

SEQ ID NO: 1541 - RNA, 19 nt, Homo sapiens
ucacaguaaaggcuguaag

SEQ ID NO: 1542 - RNA, 19 nt, Homo sapiens
ucgaaagccuuucuaauuc

SEQ ID NO: 1543 - RNA, 19 nt, Homo sapiens
ggggcauauaucgaaagcc

SEQ ID NO: 1544 - RNA, 19 nt, Homo sapiens
ucaccagggggcauauauc

SEQ ID NO: 1545 - RNA, 19 nt, Homo sapiens
agcugugucgauuuucacc

SEQ ID NO: 1546 - RNA, 19 nt, Homo sapiens
uuuaauuagagcugugucg

SEQ ID NO: 1547 - RNA, 19 nt, Homo sapiens
ugucagcuuuaauuagagc

SEQ ID NO: 1548 - RNA, 19 nt, Homo sapiens
ucaagcagaaaguugucag

SEQ ID NO: 1549 - RNA, 19 nt, Homo sapiens
uguauuuucaagcagaaag

SEQ ID NO: 1550 - RNA, 19 nt, Homo sapiens
ugggcuggcaguguauuuu

SEQ ID NO: 1551 - RNA, 19 nt, Homo sapiens
uguaaaggugcucugggcu

SEQ ID NO: 1552 - RNA, 19 nt, Homo sapiens
auggccaauguaaaggugc

SEQ ID NO: 1553 - RNA, 19 nt, Homo sapiens
acgcagaaauggccaaugu

SEQ ID NO: 1554 - RNA, 19 nt, Homo sapiens
agggaaagagcauacgcag

SEQ ID NO: 1555 - RNA, 19 nt, Homo sapiens
uuuuaucucccagggaaag

SEQ ID NO: 1556 - RNA, 19 nt, Homo sapiens
ugugggugaguuuuaucuc

SEQ ID NO: 1557 - RNA, 19 nt, Homo sapiens
aacgaaacugugggugagu

SEQ ID NO: 1558 - RNA, 19 nt, Homo sapiens
aaacaauugaacgaaacug

SEQ ID NO: 1559 - RNA, 19 nt, Homo sapiens
uucaaagcugaaacaauug

SEQ ID NO: 1560 - RNA, 19 nt, Homo sapiens
aaagcuucucucuucaaag

SEQ ID NO: 1561 - RNA, 19 nt, Homo sapiens
uuuaaccaaagcuucucuc

SEQ ID NO: 1562 - RNA, 19 nt, Homo sapiens
uggguggauuaccuuuaac

SEQ ID NO: 1563 - RNA, 19 nt, Homo sapiens
aacgauaaauggguggauu

SEQ ID NO: 1564 - RNA, 19 nt, Homo sapiens
uuuccaaaaacgauaaaug

SEQ ID NO: 1565 - RNA, 19 nt, Homo sapiens
ugaagauugucuuuccaaa

SEQ ID NO: 1566 - RNA, 19 nt, Homo sapiens
ugucuuuaugcugaagauu

SEQ ID NO: 1567 - RNA, 19 nt, Homo sapiens
guacagagcugucuuuaug

SEQ ID NO: 1568 - RNA, 19 nt, Homo sapiens
accaguguuagguacagag

SEQ ID NO: 1569 - RNA, 19 nt, Homo sapiens
auacgugccguaccagugu

SEQ ID NO: 1570 - RNA, 19 nt, Homo sapiens
uguuucuaccauacgugcc

SEQ ID NO: 1571 - RNA, 19 nt, Homo sapiens
auaggcaguuguuucuacc

SEQ ID NO: 1572 - RNA, 19 nt, Homo sapiens
aguaaagcauaggcaguug

SEQ ID NO: 1573 - RNA, 19 nt, Homo sapiens
uucagacuggugaguaaag

SEQ ID NO: 1574 - RNA, 19 nt, Homo sapiens
auaucuuucaaguucagac

SEQ ID NO: 1575 - RNA, 19 nt, Homo sapiens
uaauuuauaucuuucaagu

SEQ ID NO: 1576 - RNA, 19 nt, Homo sapiens
uggguuaacauaauuuaua

SEQ ID NO: 1577 - RNA, 19 nt, Homo sapiens
auuugaugacuggguuaac

SEQ ID NO: 1578 - RNA, 19 nt, Homo sapiens
ucugauagccauuugauga

SEQ ID NO: 1579 - RNA, 19 nt, Homo sapiens
uaccucugcucuucugaua

SEQ ID NO: 1580 - RNA, 19 nt, Homo sapiens
aagccaccuccauaccucu

SEQ ID NO: 1581 - RNA, 19 nt, Homo sapiens
guugaauaaaagccaccuc

SEQ ID NO: 1582 - RNA, 19 nt, Homo sapiens
uuguguccuggguugaaua

SEQ ID NO: 1583 - RNA, 19 nt, Homo sapiens
auggcauugauuguguccu

SEQ ID NO: 1584 - RNA, 19 nt, Homo sapiens
cccucaauggcauugauug

SEQ ID NO: 1585 - RNA, 19 nt, Homo sapiens
uuccgucaggcccucaaug

SEQ ID NO: 1586 - RNA, 19 nt, Homo sapiens
ccaggagugaauauuccgu

SEQ ID NO: 1587 - RNA, 19 nt, Homo sapiens
uuguuuaaccaggagugaa

SEQ ID NO: 1588 - RNA, 19 nt, Homo sapiens
caagcggaguuguuuaacc

SEQ ID NO: 1589 - RNA, 19 nt, Homo sapiens
gauguccauacucaagcgg

SEQ ID NO: 1590 - RNA, 19 nt, Homo sapiens
guaagaaacaucgaugucc

SEQ ID NO: 1591 - RNA, 19 nt, Homo sapiens
augcuuguaagaaacaucg

SEQ ID NO: 1592 - RNA, 19 nt, Homo sapiens
uaaggcaccuuuaugcuug

SEQ ID NO: 1593 - RNA, 19 nt, Homo sapiens
uuauaauuauguaaggcac

SEQ ID NO: 1594 - RNA, 19 nt, Homo sapiens
ugucauuuuauaauuaugu

SEQ ID NO: 1595 - RNA, 19 nt, Homo sapiens
aauucuugucugucauuuu

SEQ ID NO: 1596 - RNA, 19 nt, Homo sapiens
ccucccaaggaaauucuug

SEQ ID NO: 1597 - RNA, 19 nt, Homo sapiens
cucuacuggccucccaagg

SEQ ID NO: 1598 - RNA, 19 nt, Homo sapiens
auugagaagcaccucuacu

SEQ ID NO: 1599 - RNA, 19 nt, Homo sapiens
ugaggucaucauugagaag

SEQ ID NO: 1600 - RNA, 19 nt, Homo sapiens
uguacugacaaugagguca

SEQ ID NO: 1601 - RNA, 19 nt, Homo sapiens
ugccaaauccuguacugac

SEQ ID NO: 1602 - RNA, 19 nt, Homo sapiens
caagccacugccaaauccu

SEQ ID NO: 1603 - RNA, 19 nt, Homo sapiens
auguacuguagccaagcca

SEQ ID NO: 1604 - RNA, 19 nt, Homo sapiens
uuguuacauguacuguagc

SEQ ID NO: 1605 - RNA, 19 nt, Homo sapiens
uuugugaacuacaguuguu

SEQ ID NO: 1606 - RNA, 19 nt, Homo sapiens
uacugguuuugugaacuac

SEQ ID NO: 1607 - RNA, 19 nt, Homo sapiens
uccucagagguacugguuu

SEQ ID NO: 1608 - RNA, 19 nt, Homo sapiens
aaagcugcaaacuuccuca

SEQ ID NO: 1609 - RNA, 19 nt, Homo sapiens
uuuucaaauaaaagcugca

SEQ ID NO: 1610 - RNA, 19 nt, Homo sapiens
ugaguaucgauuuucaaau

SEQ ID NO: 1611 - RNA, 19 nt, Homo sapiens
uucaauauccugaguaucg

SEQ ID NO: 1612 - RNA, 19 nt, Homo sapiens
gugggaugcuucaauaucc

SEQ ID NO: 1613 - RNA, 19 nt, Homo sapiens
cucuguagugggaugcuuc

SEQ ID NO: 1614 - RNA, 19 nt, Homo sapiens
uuuccguagccucuguagu

SEQ ID NO: 1615 - RNA, 19 nt, Homo sapiens
uuuguaaucagaguuuccg

SEQ ID NO: 1616 - RNA, 19 nt, Homo sapiens
uacuaugcguuuguaauca

SEQ ID NO: 1617 - RNA, 19 nt, Homo sapiens
cuggcacaugcuacuaugc

SEQ ID NO: 1618 - RNA, 19 nt, Homo sapiens
gcuuguagcuggcacaugc

SEQ ID NO: 1619 - RNA, 19 nt, Homo sapiens
uucccugcugggcuuguag

SEQ ID NO: 1620 - RNA, 19 nt, Homo sapiens
ugaugauucuucccugcug

SEQ ID NO: 1621 - RNA, 19 nt, Homo sapiens
aggauccagaugaugauuc

SEQ ID NO: 1622 - RNA, 19 nt, Homo sapiens
aucaccgcaugagaggauc

SEQ ID NO: 1623 - RNA, 19 nt, Homo sapiens
auguccaucaccgcaugag

SEQ ID NO: 1624 - RNA, 19 nt, Homo sapiens
aggcaaggagauguccauc

SEQ ID NO: 1625 - RNA, 19 nt, Homo sapiens
acugauuccaguaggcaag

SEQ ID NO: 1626 - RNA, 19 nt, Homo sapiens
ucuucauuugcacugauuc

SEQ ID NO: 1627 - RNA, 19 nt, Homo sapiens
uuuuaagucuucuucauuu

SEQ ID NO: 1628 - RNA, 19 nt, Homo sapiens
caagggcuuuuaagucuuc

SEQ ID NO: 1629 - RNA, 19 nt, Homo sapiens
auccaccccuuccacaagg

SEQ ID NO: 1630 - RNA, 19 nt, Homo sapiens
auaguugauccaccccuuc

SEQ ID NO: 1631 - RNA, 19 nt, Homo sapiens
uaaucagugaauaguugau

SEQ ID NO: 1632 - RNA, 19 nt, Homo sapiens
uuugauuugguaaucagug

SEQ ID NO: 1633 - RNA, 19 nt, Homo sapiens
uaacauguccaucuuugau

SEQ ID NO: 1634 - RNA, 19 nt, Homo sapiens
guugcagaauaacaugucc

SEQ ID NO: 1635 - RNA, 19 nt, Homo sapiens
aaucgaauucaguugcaga

SEQ ID NO: 1636 - RNA, 19 nt, Homo sapiens
acuggagggaaucgaauuc

SEQ ID NO: 1637 - RNA, 19 nt, Homo sapiens
aaaggaaaucacuggaggg

SEQ ID NO: 1638 - RNA, 19 nt, Homo sapiens
aucguacacaaaggaaauc

SEQ ID NO: 1639 - RNA, 19 nt, Homo sapiens
caaauauccggaaucguac

SEQ ID NO: 1640 - RNA, 19 nt, Homo sapiens
caaagaguucaaauauccg

SEQ ID NO: 1641 - RNA, 19 nt, Homo sapiens
aaacccaacuucaaagagu

SEQ ID NO: 1642 - RNA, 19 nt, Homo sapiens
aggacugagaaacccaacu

SEQ ID NO: 1643 - RNA, 19 nt, Homo sapiens
aaaguggcaggacugagaa

SEQ ID NO: 1644 - RNA, 19 nt, Homo sapiens
uucguacacugugaaagug

SEQ ID NO: 1645 - RNA, 19 nt, Homo sapiens
gugguauucguacacugug

SEQ ID NO: 1646 - RNA, 19 nt, Homo sapiens
uguuuaucuggucuguggu

SEQ ID NO: 1647 - RNA, 19 nt, Homo sapiens
ugguacacuguuuaucugg

SEQ ID NO: 1648 - RNA, 19 nt, Homo sapiens
uauaaaacaugguacacug

SEQ ID NO: 1649 - RNA, 19 nt, Homo sapiens
auuggaagugcuauaaaac

SEQ ID NO: 1650 - RNA, 19 nt, Homo sapiens
ugaauuuugauauuggaag

SEQ ID NO: 1651 - RNA, 19 nt, Homo sapiens
agacuuucugaauuuugau

SEQ ID NO: 1652 - RNA, 19 nt, Homo sapiens
ggcuccuucacagacuuuc

SEQ ID NO: 1653 - RNA, 19 nt, Homo sapiens
acuugcacgcggcuccuuc

SEQ ID NO: 1654 - RNA, 19 nt, Homo sapiens
gcuucuacacacuugcacg

SEQ ID NO: 1655 - RNA, 19 nt, Homo sapiens
gcccacaaucagcuucuac

SEQ ID NO: 1656 - RNA, 19 nt, Homo sapiens
ugcauuugcccacaaucag

SEQ ID NO: 1657 - RNA, 19 nt, Homo sapiens
caauucuuccugcauuugc

SEQ ID NO: 1658 - RNA, 19 nt, Homo sapiens
uugucagauccaauucuuc

SEQ ID NO: 1659 - RNA, 19 nt, Homo sapiens
ucucugcagagauugucag

SEQ ID NO: 1660 - RNA, 19 nt, Homo sapiens
uuuguuuucuugucucugc

SEQ ID NO: 1661 - RNA, 19 nt, Homo sapiens
caugcuguuuguuuucuug

SEQ ID NO: 1662 - RNA, 19 nt, Homo sapiens
ucucugguuuacaugcugu

SEQ ID NO: 1663 - RNA, 19 nt, Homo sapiens
aagcauaugcaaucucugg

SEQ ID NO: 1664 - RNA, 19 nt, Homo sapiens
uaacuuuauaagcauaugc

SEQ ID NO: 1665 - RNA, 19 nt, Homo sapiens
ugugaugcuaacuuuauaa

SEQ ID NO: 1666 - RNA, 19 nt, Homo sapiens
uacagugauggaugugaug

SEQ ID NO: 1667 - RNA, 19 nt, Homo sapiens
aaaacauuuucuacaguga

SEQ ID NO: 1668 - RNA, 19 nt, Homo sapiens
cuugacaaaaacauuuucu

SEQ ID NO: 1669 - RNA, 19 nt, Homo sapiens
uugccuuguacuugacaaa

SEQ ID NO: 1670 - RNA, 19 nt, Homo sapiens
auauccagaaggguugccu

SEQ ID NO: 1671 - RNA, 19 nt, Homo sapiens
uuuguagauauccagaagg

SEQ ID NO: 1672 - RNA, 19 nt, Homo sapiens
uuccccaguuuuguagaua

SEQ ID NO: 1673 - RNA, 19 nt, Homo sapiens
ucagcaacagcuuccccag

SEQ ID NO: 1674 - RNA, 19 nt, Homo sapiens
gagucuuucucagcaacag

SEQ ID NO: 1675 - RNA, 19 nt, Homo sapiens
ugaagguaaucucagaguc

SEQ ID NO: 1676 - RNA, 19 nt, Homo sapiens
uuuuaaugaagguaaucuc

SEQ ID NO: 1677 - RNA, 19 nt, Homo sapiens
uacagguuaccuuuuuaau

SEQ ID NO: 1678 - RNA, 19 nt, Homo sapiens
ucagcguuaguacagguua

SEQ ID NO: 1679 - RNA, 19 nt, Homo sapiens
uuuaccagcucagcguuag

SEQ ID NO: 1680 - RNA, 19 nt, Homo sapiens
guacugucuuccuuuuacc

SEQ ID NO: 1681 - RNA, 19 nt, Homo sapiens
auaauuaaguacugucuuc

SEQ ID NO: 1682 - RNA, 19 nt, Homo sapiens
uucuuuacccauaauuaag

SEQ ID NO: 1683 - RNA, 19 nt, Homo sapiens
uaucuggagggcuucuuua

SEQ ID NO: 1684 - RNA, 19 nt, Homo sapiens
auuguauuuuaucuggagg

SEQ ID NO: 1685 - RNA, 19 nt, Homo sapiens
ugaaacugaaauuguauuu

SEQ ID NO: 1686 - RNA, 19 nt, Homo sapiens
guagauguaccugaaacug

SEQ ID NO: 1687 - RNA, 19 nt, Homo sapiens
ucuaaaggguagauguacc

SEQ ID NO: 1688 - RNA, 19 nt, Homo sapiens
aggucaaggaaucuaaagg

SEQ ID NO: 1689 - RNA, 19 nt, Homo sapiens
uauucaauccaggucaagg

SEQ ID NO: 1690 - RNA, 19 nt, Homo sapiens
cuaggccaguauucaaucc

SEQ ID NO: 1691 - RNA, 19 nt, Homo sapiens
uguugugucucuaggccag

SEQ ID NO: 1692 - RNA, 19 nt, Homo sapiens
gaugaacauguugugucuc

SEQ ID NO: 1693 - RNA, 19 nt, Homo sapiens
aaugcuugacacgaugaac

SEQ ID NO: 1694 - RNA, 19 nt, Homo sapiens
uuagcuaaaaaugcuugac

SEQ ID NO: 1695 - RNA, 19 nt, Homo sapiens
aaauucaucuaaauuagcu

SEQ ID NO: 1696 - RNA, 19 nt, Homo sapiens
aucuucggcaaauucaucu

SEQ ID NO: 1697 - RNA, 19 nt, Homo sapiens
uuuaaaaagauaucuucgg

SEQ ID NO: 1698 - RNA, 19 nt, Homo sapiens
uuagcauccauuuaaaaag

SEQ ID NO: 1699 - RNA, 19 nt, Homo sapiens
uucaggaauuuuagcaucc

SEQ ID NO: 1700 - RNA, 19 nt, Homo sapiens
cugaacuucaggaauuuua

SEQ ID NO: 1701 - RNA, 19 nt, Homo sapiens
aacuguaugcagcugaacu

SEQ ID NO: 1702 - RNA, 19 nt, Homo sapiens
auaagugcaaacuguaugc

SEQ ID NO: 1703 - RNA, 19 nt, Homo sapiens
acaacaggaguccauaagu

SEQ ID NO: 1704 - RNA, 19 nt, Homo sapiens
acuucaacaacaggagucc

SEQ ID NO: 1705 - RNA, 19 nt, Homo sapiens
aaaaaaacgaacuucaaca

SEQ ID NO: 1706 - RNA, 19 nt, Homo sapiens
aaaagaagaaaacaaaaaa

SEQ ID NO: 1707 - RNA, 19 nt, Homo sapiens
aauguuuaaaaaaagaaga

SEQ ID NO: 1708 - RNA, 19 nt, Homo sapiens
agcuaugaauguuuaaaaa

SEQ ID NO: 1709 - RNA, 19 nt, Homo sapiens
uacaaauaagaccagcuau

SEQ ID NO: 1710 - RNA, 19 nt, Homo sapiens
ugagcuuuacaaauaagac

SEQ ID NO: 1711 - RNA, 19 nt, Homo sapiens
ucuaaguaaagugagcuuu

SEQ ID NO: 1712 - RNA, 19 nt, Homo sapiens
agugccacuaauucuaagu

SEQ ID NO: 1713 - RNA, 19 nt, Homo sapiens
aauaaaagcaagugccacu

SEQ ID NO: 1714 - RNA, 19 nt, Homo sapiens
aucauucucuaauaaaagc

SEQ ID NO: 1715 - RNA, 19 nt, Homo sapiens
agcauuugaaaucauucuc

SEQ ID NO: 1716 - RNA, 19 nt, Homo sapiens
aaaguuacagcauuugaaa

SEQ ID NO: 1717 - RNA, 19 nt, Homo sapiens
uguuauuucagaaaguuac

SEQ ID NO: 1718 - RNA, 19 nt, Homo sapiens
uccaaggccauguuauuuc

SEQ ID NO: 1719 - RNA, 19 nt, Homo sapiens
gucuucaugcccuccaagg

SEQ ID NO: 1720 - RNA, 19 nt, Homo sapiens
guaucugucuucaugcccu

SEQ ID NO: 1721 - RNA, 19 nt, Homo sapiens
auaaccuuggaggaguauc

SEQ ID NO: 1722 - RNA, 19 nt, Homo sapiens
uguccaauaaccuuggagg

SEQ ID NO: 1723 - RNA, 19 nt, Homo sapiens
uuuauuguuuccggugucc

SEQ ID NO: 1724 - RNA, 19 nt, Homo sapiens
uguuccaauuuauuguuuc

SEQ ID NO: 1725 - RNA, 19 nt, Homo sapiens
uuugaggagguguuccaau

SEQ ID NO: 1726 - RNA, 19 nt, Homo sapiens
ugagugguagguuugagga

SEQ ID NO: 1727 - RNA, 19 nt, Homo sapiens
aaacauuccugagugguag

SEQ ID NO: 1728 - RNA, 19 nt, Homo sapiens
uucggccccagcaaacauu

SEQ ID NO: 1729 - RNA, 19 nt, Homo sapiens
uguucuuucggccccagca

SEQ ID NO: 1730 - RNA, 19 nt, Homo sapiens
uuucaauggacuguucuuu

SEQ ID NO: 1731 - RNA, 19 nt, Homo sapiens
guaauacucccuuucaaug

SEQ ID NO: 1732 - RNA, 19 nt, Homo sapiens
cauguuuuuguaauacucc

SEQ ID NO: 1733 - RNA, 19 nt, Homo sapiens
caagcaaaggccauguuuu

SEQ ID NO: 1734 - RNA, 19 nt, Homo sapiens
uuuucuuucaagcaaaggc

SEQ ID NO: 1735 - RNA, 19 nt, Homo sapiens
uuccuugguauuuucuuuc

SEQ ID NO: 1736 - RNA, 19 nt, Homo sapiens
ucaguuuccuguuccuugg

SEQ ID NO: 1737 - RNA, 19 nt, Homo sapiens
caggcuuuaaugaucaguu

SEQ ID NO: 1738 - RNA, 19 nt, Homo sapiens
agcaaacucaggcuuuaau

SEQ ID NO: 1739 - DNA, 21 bp, Artificial Sequence
  Description of Artificial Sequence: Synthetic oligonucleotide
  Description of Combined DNA/RNA Molecule: Synthetic oligonucleotide
uauccgugguuuccugcuatt

SEQ ID NO: 1740 - DNA, 21 bp, Artificial Sequence
  Description of Artificial Sequence: Synthetic oligonucleotide
  Description of Combined DNA/RNA Molecule: Synthetic oligonucleotide
gguuuccugcuaccuccaatt

SEQ ID NO: 1741 - DNA, 21 bp, Artificial Sequence
  Description of Artificial Sequence: Synthetic oligonucleotide
  Description of Combined DNA/RNA Molecule: Synthetic oligonucleotide
ccuccaaccaugggccuuutt

SEQ ID NO: 1742 - DNA, 21 bp, Artificial Sequence
  Description of Artificial Sequence: Synthetic oligonucleotide
  Description of Combined DNA/RNA Molecule: Synthetic oligonucleotide
gggccuuuugggaauacuutt

SEQ ID NO: 1743 - DNA, 21 bp, Artificial Sequence
  Description of Artificial Sequence: Synthetic oligonucleotide
  Description of Combined DNA/RNA Molecule: Synthetic oligonucleotide
ggaauacuuuguuuuuuaatt

SEQ ID NO: 1744 - DNA, 21 bp, Artificial Sequence
  Description of Artificial Sequence: Synthetic oligonucleotide
  Description of Combined DNA/RNA Molecule: Synthetic oligonucleotide
cuuuguuuuuuaaucuucctt

SEQ ID NO: 1745 - DNA, 21 bp, Artificial Sequence
  Description of Artificial Sequence: Synthetic oligonucleotide
  Description of Combined DNA/RNA Molecule: Synthetic oligonucleotide
cuuccuggggaaaaccuggtt

SEQ ID NO: 1746 - DNA, 21 bp, Artificial Sequence
  Description of Artificial Sequence: Synthetic oligonucleotide
  Description of Combined DNA/RNA Molecule: Synthetic oligonucleotide
ggaaaaccuggggacaggatt

SEQ ID NO: 1747 - DNA, 21 bp, Artificial Sequence
  Description of Artificial Sequence: Synthetic oligonucleotide
  Description of Combined DNA/RNA Molecule: Synthetic oligonucleotide
gggacaggagcaaacauautt

SEQ ID NO: 1748 - DNA, 21 bp, Artificial Sequence
  Description of Artificial Sequence: Synthetic oligonucleotide
  Description of Combined DNA/RNA Molecule: Synthetic oligonucleotide
caaacauaugucauuucagtt

SEQ ID NO: 1749 - DNA, 21 bp, Artificial Sequence
  Description of Artificial Sequence: Synthetic oligonucleotide
  Description of Combined DNA/RNA Molecule: Synthetic oligonucleotide
cauuucagcaccaaaaauatt

SEQ ID NO: 1750 - DNA, 21 bp, Artificial Sequence
  Description of Artificial Sequence: Synthetic oligonucleotide
  Description of Combined DNA/RNA Molecule: Synthetic oligonucleotide
gcaccaaaaauauuccgugtt

SEQ ID NO: 1751 - DNA, 21 bp, Artificial Sequence
  Description of Artificial Sequence: Synthetic oligonucleotide
  Description of Combined DNA/RNA Molecule: Synthetic oligonucleotide
ccguguuggagcaucugaatt

SEQ ID NO: 1752 - DNA, 21 bp, Artificial Sequence
  Description of Artificial Sequence: Synthetic oligonucleotide
  Description of Combined DNA/RNA Molecule: Synthetic oligonucleotide
ggagcaucugaaaauauugtt

SEQ ID NO: 1753 - DNA, 21 bp, Artificial Sequence
  Description of Artificial Sequence: Synthetic oligonucleotide
  Description of Combined DNA/RNA Molecule: Synthetic oligonucleotide
gaaaauauugugauucaagtt

SEQ ID NO: 1754 - DNA, 21 bp, Artificial Sequence
  Description of Artificial Sequence: Synthetic oligonucleotide
  Description of Combined DNA/RNA Molecule: Synthetic oligonucleotide
gauucaaguuuauggauactt

SEQ ID NO: 1755 - DNA, 21 bp, Artificial Sequence
  Description of Artificial Sequence: Synthetic oligonucleotide
  Description of Combined DNA/RNA Molecule: Synthetic oligonucleotide
ggauacacugaagcauuugtt

SEQ ID NO: 1756 - DNA, 21 bp, Artificial Sequence
  Description of Artificial Sequence: Synthetic oligonucleotide
  Description of Combined DNA/RNA Molecule: Synthetic oligonucleotide
gaagcauuugaugcaacaatt

SEQ ID NO: 1757 - DNA, 21 bp, Artificial Sequence
  Description of Artificial Sequence: Synthetic oligonucleotide
  Description of Combined DNA/RNA Molecule: Synthetic oligonucleotide
ugcaacaaucucuauuaaatt

SEQ ID NO: 1758 - DNA, 21 bp, Artificial Sequence
  Description of Artificial Sequence: Synthetic oligonucleotide
  Description of Combined DNA/RNA Molecule: Synthetic oligonucleotide
aaucucuauuaaaaguuautt

SEQ ID NO: 1759 - DNA, 21 bp, Artificial Sequence
  Description of Artificial Sequence: Synthetic oligonucleotide
  Description of Combined DNA/RNA Molecule: Synthetic oligonucleotide
aaguuauccugauaaaaaatt

SEQ ID NO: 1760 - DNA, 21 bp, Artificial Sequence
  Description of Artificial Sequence: Synthetic oligonucleotide
  Description of Combined DNA/RNA Molecule: Synthetic oligonucleotide
cugauaaaaaauuuaguuatt

SEQ ID NO: 1761 - DNA, 21 bp, Artificial Sequence
  Description of Artificial Sequence: Synthetic oligonucleotide
  Description of Combined DNA/RNA Molecule: Synthetic oligonucleotide
uuaguuacuccucaggccatt

SEQ ID NO: 1762 - DNA, 21 bp, Artificial Sequence
  Description of Artificial Sequence: Synthetic oligonucleotide
  Description of Combined DNA/RNA Molecule: Synthetic oligonucleotide
ccucaggccauguucauuutt

SEQ ID NO: 1763 - DNA, 21 bp, Artificial Sequence
  Description of Artificial Sequence: Synthetic oligonucleotide
  Description of Combined DNA/RNA Molecule: Synthetic oligonucleotide
uucauuuauccucagagaatt

SEQ ID NO: 1764 - DNA, 21 bp, Artificial Sequence
  Description of Artificial Sequence: Synthetic oligonucleotide
  Description of Combined DNA/RNA Molecule: Synthetic oligonucleotide
cucagagaauaaauuccaatt

SEQ ID NO: 1765 - DNA, 21 bp, Artificial Sequence
  Description of Artificial Sequence: Synthetic oligonucleotide
  Description of Combined DNA/RNA Molecule: Synthetic oligonucleotide
aauaaauuccaaaacucugtt

SEQ ID NO: 1766 - DNA, 21 bp, Artificial Sequence
  Description of Artificial Sequence: Synthetic oligonucleotide
  Description of Combined DNA/RNA Molecule: Synthetic oligonucleotide
cucugcaaucuuaacaauatt

SEQ ID NO: 1767 - DNA, 21 bp, Artificial Sequence
  Description of Artificial Sequence: Synthetic oligonucleotide
  Description of Combined DNA/RNA Molecule: Synthetic oligonucleotide
cuuaacaauacaaccaaaatt

SEQ ID NO: 1768 - DNA, 21 bp, Artificial Sequence
  Description of Artificial Sequence: Synthetic oligonucleotide
  Description of Combined DNA/RNA Molecule: Synthetic oligonucleotide
caaccaaaacaauugccugtt

SEQ ID NO: 1769 - DNA, 21 bp, Artificial Sequence
  Description of Artificial Sequence: Synthetic oligonucleotide
  Description of Combined DNA/RNA Molecule: Synthetic oligonucleotide
caauugccuggaggacaaatt

SEQ ID NO: 1770 - DNA, 21 bp, Artificial Sequence
  Description of Artificial Sequence: Synthetic oligonucleotide
  Description of Combined DNA/RNA Molecule: Synthetic oligonucleotide
ggacaaaacccaguuucuutt

SEQ ID NO: 1771 - DNA, 21 bp, Artificial Sequence
  Description of Artificial Sequence: Synthetic oligonucleotide
  Description of Combined DNA/RNA Molecule: Synthetic oligonucleotide
ccaguuucuuauguguauutt

SEQ ID NO: 1772 - DNA, 21 bp, Artificial Sequence
  Description of Artificial Sequence: Synthetic oligonucleotide
  Description of Combined DNA/RNA Molecule: Synthetic oligonucleotide
auguguauuuggaaguugutt

SEQ ID NO: 1773 - DNA, 21 bp, Artificial Sequence
  Description of Artificial Sequence: Synthetic oligonucleotide
  Description of Combined DNA/RNA Molecule: Synthetic oligonucleotide
ggaaguuguaucaaagcautt

SEQ ID NO: 1774 - DNA, 21 bp, Artificial Sequence
  Description of Artificial Sequence: Synthetic oligonucleotide
  Description of Combined DNA/RNA Molecule: Synthetic oligonucleotide
guaucaaagcauuuuucaatt

SEQ ID NO: 1775 - DNA, 21 bp, Artificial Sequence
  Description of Artificial Sequence: Synthetic oligonucleotide
  Description of Combined DNA/RNA Molecule: Synthetic oligonucleotide
uuuucaaaaucaaaaagaatt

SEQ ID NO: 1776 - DNA, 21 bp, Artificial Sequence
  Description of Artificial Sequence: Synthetic oligonucleotide
  Description of Combined DNA/RNA Molecule: Synthetic oligonucleotide
caaaaagaaugccaauaactt

SEQ ID NO: 1777 - DNA, 21 bp, Artificial Sequence
  Description of Artificial Sequence: Synthetic oligonucleotide
  Description of Combined DNA/RNA Molecule: Synthetic oligonucleotide
gccaauaaccuaugacaautt

SEQ ID NO: 1778 - DNA, 21 bp, Artificial Sequence
  Description of Artificial Sequence: Synthetic oligonucleotide
  Description of Combined DNA/RNA Molecule: Synthetic oligonucleotide
ccuaugacaauggauuucutt

SEQ ID NO: 1779 - DNA, 21 bp, Artificial Sequence
  Description of Artificial Sequence: Synthetic oligonucleotide
  Description of Combined DNA/RNA Molecule: Synthetic oligonucleotide
uggauuucucuucauucautt

SEQ ID NO: 1780 - DNA, 21 bp, Artificial Sequence
  Description of Artificial Sequence: Synthetic oligonucleotide
  Description of Combined DNA/RNA Molecule: Synthetic oligonucleotide
cauucauacagacaaaccutt

SEQ ID NO: 1781 - DNA, 21 bp, Artificial Sequence
  Description of Artificial Sequence: Synthetic oligonucleotide
  Description of Combined DNA/RNA Molecule: Synthetic oligonucleotide
cagacaaaccuguuuauactt

SEQ ID NO: 1782 - DNA, 21 bp, Artificial Sequence
  Description of Artificial Sequence: Synthetic oligonucleotide
  Description of Combined DNA/RNA Molecule: Synthetic oligonucleotide
guuuauacuccagaccagutt

SEQ ID NO: 1783 - DNA, 21 bp, Artificial Sequence
  Description of Artificial Sequence: Synthetic oligonucleotide
  Description of Combined DNA/RNA Molecule: Synthetic oligonucleotide
agaccagucaguaaaaguutt

SEQ ID NO: 1784 - DNA, 21 bp, Artificial Sequence
  Description of Artificial Sequence: Synthetic oligonucleotide
  Description of Combined DNA/RNA Molecule: Synthetic oligonucleotide
aguaaaaguuagaguuuautt

SEQ ID NO: 1785 - DNA, 21 bp, Artificial Sequence
  Description of Artificial Sequence: Synthetic oligonucleotide
  Description of Combined DNA/RNA Molecule: Synthetic oligonucleotide
agaguuuauucguugaaugtt

SEQ ID NO: 1786 - DNA, 21 bp, Artificial Sequence
  Description of Artificial Sequence: Synthetic oligonucleotide
  Description of Combined DNA/RNA Molecule: Synthetic oligonucleotide
cguugaaugacgacuugaatt

SEQ ID NO: 1787 - DNA, 21 bp, Artificial Sequence
  Description of Artificial Sequence: Synthetic oligonucleotide
  Description of Combined DNA/RNA Molecule: Synthetic oligonucleotide
cuugaagccagccaaaagatt

SEQ ID NO: 1788 - DNA, 21 bp, Artificial Sequence
  Description of Artificial Sequence: Synthetic oligonucleotide
  Description of Combined DNA/RNA Molecule: Synthetic oligonucleotide
ccagccaaaagagaaacugtt

SEQ ID NO: 1789 - DNA, 21 bp, Artificial Sequence
  Description of Artificial Sequence: Synthetic oligonucleotide
  Description of Combined DNA/RNA Molecule: Synthetic oligonucleotide
aaacugucuuaacuuucautt

SEQ ID NO: 1790 - DNA, 21 bp, Artificial Sequence
  Description of Artificial Sequence: Synthetic oligonucleotide
  Description of Combined DNA/RNA Molecule: Synthetic oligonucleotide
aacuuucauagauccugaatt

SEQ ID NO: 1791 - DNA, 21 bp, Artificial Sequence
  Description of Artificial Sequence: Synthetic oligonucleotide
  Description of Combined DNA/RNA Molecule: Synthetic oligonucleotide
cauagauccugaaggaucatt

SEQ ID NO: 1792 - DNA, 21 bp, Artificial Sequence
  Description of Artificial Sequence: Synthetic oligonucleotide
  Description of Combined DNA/RNA Molecule: Synthetic oligonucleotide
gaaggaucagaaguugacatt

SEQ ID NO: 1793 - DNA, 21 bp, Artificial Sequence
  Description of Artificial Sequence: Synthetic oligonucleotide
  Description of Combined DNA/RNA Molecule: Synthetic oligonucleotide
ugacaugguagaagaaauutt

SEQ ID NO: 1794 - DNA, 21 bp, Artificial Sequence
  Description of Artificial Sequence: Synthetic oligonucleotide
  Description of Combined DNA/RNA Molecule: Synthetic oligonucleotide
gaagaaauugaucauauugtt

SEQ ID NO: 1795 - DNA, 21 bp, Artificial Sequence
  Description of Artificial Sequence: Synthetic oligonucleotide
  Description of Combined DNA/RNA Molecule: Synthetic oligonucleotide
gaucauauuggaauuaucutt

SEQ ID NO: 1796 - DNA, 21 bp, Artificial Sequence
  Description of Artificial Sequence: Synthetic oligonucleotide
  Description of Combined DNA/RNA Molecule: Synthetic oligonucleotide
ggaauuaucucuuuuccugtt

SEQ ID NO: 1797 - DNA, 21 bp, Artificial Sequence
  Description of Artificial Sequence: Synthetic oligonucleotide
  Description of Combined DNA/RNA Molecule: Synthetic oligonucleotide
cucuuuuccugacuucaagtt

SEQ ID NO: 1798 - DNA, 21 bp, Artificial Sequence
  Description of Artificial Sequence: Synthetic oligonucleotide
  Description of Combined DNA/RNA Molecule: Synthetic oligonucleotide
acuucaagauuccgucuaatt

SEQ ID NO: 1799 - DNA, 21 bp, Artificial Sequence
  Description of Artificial Sequence: Synthetic oligonucleotide
  Description of Combined DNA/RNA Molecule: Synthetic oligonucleotide
ccgucuaauccuagauaugtt

SEQ ID NO: 1800 - DNA, 21 bp, Artificial Sequence
  Description of Artificial Sequence: Synthetic oligonucleotide
  Description of Combined DNA/RNA Molecule: Synthetic oligonucleotide
ccuagauaugguauguggatt

SEQ ID NO: 1801 - DNA, 21 bp, Artificial Sequence
  Description of Artificial Sequence: Synthetic oligonucleotide
  Description of Combined DNA/RNA Molecule: Synthetic oligonucleotide
uguggacgaucaaggcuaatt

SEQ ID NO: 1802 - DNA, 21 bp, Artificial Sequence
  Description of Artificial Sequence: Synthetic oligonucleotide
  Description of Combined DNA/RNA Molecule: Synthetic oligonucleotide
cgaucaaggcuaaauauaatt

SEQ ID NO: 1803 - DNA, 21 bp, Artificial Sequence
  Description of Artificial Sequence: Synthetic oligonucleotide
  Description of Combined DNA/RNA Molecule: Synthetic oligonucleotide
auauaaagaggacuuuucatt

SEQ ID NO: 1804 - DNA, 21 bp, Artificial Sequence
  Description of Artificial Sequence: Synthetic oligonucleotide
  Description of Combined DNA/RNA Molecule: Synthetic oligonucleotide
gaggacuuuucaacaacugtt

SEQ ID NO: 1805 - DNA, 21 bp, Artificial Sequence
  Description of Artificial Sequence: Synthetic oligonucleotide
  Description of Combined DNA/RNA Molecule: Synthetic oligonucleotide
caacuggaaccgcauauuutt

SEQ ID NO: 1806 - DNA, 21 bp, Artificial Sequence
  Description of Artificial Sequence: Synthetic oligonucleotide
  Description of Combined DNA/RNA Molecule: Synthetic oligonucleotide
cgcauauuuugaaguuaaatt

SEQ ID NO: 1807 - DNA, 21 bp, Artificial Sequence
  Description of Artificial Sequence: Synthetic oligonucleotide
  Description of Combined DNA/RNA Molecule: Synthetic oligonucleotide
aaguuaaagaauaugucuutt

SEQ ID NO: 1808 - DNA, 21 bp, Artificial Sequence
  Description of Artificial Sequence: Synthetic oligonucleotide
  Description of Combined DNA/RNA Molecule: Synthetic oligonucleotide
gaauaugucuugccacauutt

SEQ ID NO: 1809 - DNA, 21 bp, Artificial Sequence
  Description of Artificial Sequence: Synthetic oligonucleotide
  Description of Combined DNA/RNA Molecule: Synthetic oligonucleotide
ccacauuuuucugucucaatt

SEQ ID NO: 1810 - DNA, 21 bp, Artificial Sequence
  Description of Artificial Sequence: Synthetic oligonucleotide
  Description of Combined DNA/RNA Molecule: Synthetic oligonucleotide
cugucucaaucgagccagatt

SEQ ID NO: 1811 - DNA, 21 bp, Artificial Sequence
  Description of Artificial Sequence: Synthetic oligonucleotide
  Description of Combined DNA/RNA Molecule: Synthetic oligonucleotide
caaucgagccagaauauaatt

SEQ ID NO: 1812 - DNA, 21 bp, Artificial Sequence
  Description of Artificial Sequence: Synthetic oligonucleotide
  Description of Combined DNA/RNA Molecule: Synthetic oligonucleotide
gaauauaauuucauugguutt

SEQ ID NO: 1813 - DNA, 21 bp, Artificial Sequence
  Description of Artificial Sequence: Synthetic oligonucleotide
  Description of Combined DNA/RNA Molecule: Synthetic oligonucleotide
auugguuacaagaacuuuatt

SEQ ID NO: 1814 - DNA, 21 bp, Artificial Sequence
  Description of Artificial Sequence: Synthetic oligonucleotide
  Description of Combined DNA/RNA Molecule: Synthetic oligonucleotide
agaacuuuaagaauuuugatt

SEQ ID NO: 1815 - DNA, 21 bp, Artificial Sequence
  Description of Artificial Sequence: Synthetic oligonucleotide
  Description of Combined DNA/RNA Molecule: Synthetic oligonucleotide
gaauuuugaaauuacuauatt

SEQ ID NO: 1816 - DNA, 21 bp, Artificial Sequence
  Description of Artificial Sequence: Synthetic oligonucleotide
  Description of Combined DNA/RNA Molecule: Synthetic oligonucleotide
gaaauuacuauaaaagcaatt

SEQ ID NO: 1817 - DNA, 21 bp, Artificial Sequence
  Description of Artificial Sequence: Synthetic oligonucleotide
  Description of Combined DNA/RNA Molecule: Synthetic oligonucleotide
aaagcaagauauuuuuauatt

SEQ ID NO: 1818 - DNA, 21 bp, Artificial Sequence
  Description of Artificial Sequence: Synthetic oligonucleotide
  Description of Combined DNA/RNA Molecule: Synthetic oligonucleotide
auauuuuuauaauaaaguatt

SEQ ID NO: 1819 - DNA, 21 bp, Artificial Sequence
  Description of Artificial Sequence: Synthetic oligonucleotide
  Description of Combined DNA/RNA Molecule: Synthetic oligonucleotide
aaguagucacugaggcugatt

SEQ ID NO: 1820 - DNA, 21 bp, Artificial Sequence
  Description of Artificial Sequence: Synthetic oligonucleotide
  Description of Combined DNA/RNA Molecule: Synthetic oligonucleotide
cacugaggcugacguuuautt

SEQ ID NO: 1821 - DNA, 21 bp, Artificial Sequence
  Description of Artificial Sequence: Synthetic oligonucleotide
  Description of Combined DNA/RNA Molecule: Synthetic oligonucleotide
cguuuauaucacauuuggatt

SEQ ID NO: 1822 - DNA, 21 bp, Artificial Sequence
  Description of Artificial Sequence: Synthetic oligonucleotide
  Description of Combined DNA/RNA Molecule: Synthetic oligonucleotide
cacauuuggaauaagagaatt

SEQ ID NO: 1823 - DNA, 21 bp, Artificial Sequence
  Description of Artificial Sequence: Synthetic oligonucleotide
  Description of Combined DNA/RNA Molecule: Synthetic oligonucleotide
aauaagagaagacuuaaaatt

SEQ ID NO: 1824 - DNA, 21 bp, Artificial Sequence
  Description of Artificial Sequence: Synthetic oligonucleotide
  Description of Combined DNA/RNA Molecule: Synthetic oligonucleotide
cuuaaaagaugaucaaaaatt

SEQ ID NO: 1825 - DNA, 21 bp, Artificial Sequence
  Description of Artificial Sequence: Synthetic oligonucleotide
  Description of Combined DNA/RNA Molecule: Synthetic oligonucleotide
gaugaucaaaaagaaaugatt

SEQ ID NO: 1826 - DNA, 21 bp, Artificial Sequence
  Description of Artificial Sequence: Synthetic oligonucleotide
  Description of Combined DNA/RNA Molecule: Synthetic oligonucleotide
aaaugaugcaaacagcaautt

SEQ ID NO: 1827 - DNA, 21 bp, Artificial Sequence
  Description of Artificial Sequence: Synthetic oligonucleotide
  Description of Combined DNA/RNA Molecule: Synthetic oligonucleotide
acagcaaugcaaaacacaatt

SEQ ID NO: 1828 - DNA, 21 bp, Artificial Sequence
  Description of Artificial Sequence: Synthetic oligonucleotide
  Description of Combined DNA/RNA Molecule: Synthetic oligonucleotide
aaaacacaauguugauaaatt

SEQ ID NO: 1829 - DNA, 21 bp, Artificial Sequence
  Description of Artificial Sequence: Synthetic oligonucleotide
  Description of Combined DNA/RNA Molecule: Synthetic oligonucleotide
caauguugauaaauggaautt

SEQ ID NO: 1830 - DNA, 21 bp, Artificial Sequence
  Description of Artificial Sequence: Synthetic oligonucleotide
  Description of Combined DNA/RNA Molecule: Synthetic oligonucleotide
ggaauugcucaagucacautt

SEQ ID NO: 1831 - DNA, 21 bp, Artificial Sequence
  Description of Artificial Sequence: Synthetic oligonucleotide
  Description of Combined DNA/RNA Molecule: Synthetic oligonucleotide
gcucaagucacauuugauutt

SEQ ID NO: 1832 - DNA, 21 bp, Artificial Sequence
  Description of Artificial Sequence: Synthetic oligonucleotide
  Description of Combined DNA/RNA Molecule: Synthetic oligonucleotide
auuugauucugaaacagcatt

SEQ ID NO: 1833 - DNA, 21 bp, Artificial Sequence
  Description of Artificial Sequence: Synthetic oligonucleotide
  Description of Combined DNA/RNA Molecule: Synthetic oligonucleotide
ugaaacagcagucaaagaatt

SEQ ID NO: 1834 - DNA, 21 bp, Artificial Sequence
  Description of Artificial Sequence: Synthetic oligonucleotide
  Description of Combined DNA/RNA Molecule: Synthetic oligonucleotide
caaagaacugucauacuactt

SEQ ID NO: 1835 - DNA, 21 bp, Artificial Sequence
  Description of Artificial Sequence: Synthetic oligonucleotide
  Description of Combined DNA/RNA Molecule: Synthetic oligonucleotide
cauacuacaguuuagaagatt

SEQ ID NO: 1836 - DNA, 21 bp, Artificial Sequence
  Description of Artificial Sequence: Synthetic oligonucleotide
  Description of Combined DNA/RNA Molecule: Synthetic oligonucleotide
caguuuagaagauuuaaactt

SEQ ID NO: 1837 - DNA, 21 bp, Artificial Sequence
  Description of Artificial Sequence: Synthetic oligonucleotide
  Description of Combined DNA/RNA Molecule: Synthetic oligonucleotide
uaaacaacaaguaccuuuatt

SEQ ID NO: 1838 - DNA, 21 bp, Artificial Sequence
  Description of Artificial Sequence: Synthetic oligonucleotide
  Description of Combined DNA/RNA Molecule: Synthetic oligonucleotide
caaguaccuuuauauugcutt

SEQ ID NO: 1839 - DNA, 21 bp, Artificial Sequence
  Description of Artificial Sequence: Synthetic oligonucleotide
  Description of Combined DNA/RNA Molecule: Synthetic oligonucleotide
uauugcuguaacagucauatt

SEQ ID NO: 1840 - DNA, 21 bp, Artificial Sequence
  Description of Artificial Sequence: Synthetic oligonucleotide
  Description of Combined DNA/RNA Molecule: Synthetic oligonucleotide
aacagucauagagucuacatt

SEQ ID NO: 1841 - DNA, 21 bp, Artificial Sequence
  Description of Artificial Sequence: Synthetic oligonucleotide
  Description of Combined DNA/RNA Molecule: Synthetic oligonucleotide
agagucuacagguggauuutt

SEQ ID NO: 1842 - DNA, 21 bp, Artificial Sequence
  Description of Artificial Sequence: Synthetic oligonucleotide
  Description of Combined DNA/RNA Molecule: Synthetic oligonucleotide
ggauuuucugaagaggcagtt

SEQ ID NO: 1843 - DNA, 21 bp, Artificial Sequence
  Description of Artificial Sequence: Synthetic oligonucleotide
  Description of Combined DNA/RNA Molecule: Synthetic oligonucleotide
gaagaggcagaaauaccugtt

SEQ ID NO: 1844 - DNA, 21 bp, Artificial Sequence
  Description of Artificial Sequence: Synthetic oligonucleotide
  Description of Combined DNA/RNA Molecule: Synthetic oligonucleotide
agaaauaccuggcaucaaatt

SEQ ID NO: 1845 - DNA, 21 bp, Artificial Sequence
  Description of Artificial Sequence: Synthetic oligonucleotide
  Description of Combined DNA/RNA Molecule: Synthetic oligonucleotide
gcaucaaauauguccucuctt

SEQ ID NO: 1846 - DNA, 21 bp, Artificial Sequence
  Description of Artificial Sequence: Synthetic oligonucleotide
  Description of Combined DNA/RNA Molecule: Synthetic oligonucleotide
uguccucucucccuacaaatt

SEQ ID NO: 1847 - DNA, 21 bp, Artificial Sequence
  Description of Artificial Sequence: Synthetic oligonucleotide
  Description of Combined DNA/RNA Molecule: Synthetic oligonucleotide
gaauuugguugcuacuccutt

SEQ ID NO: 1848 - DNA, 21 bp, Artificial Sequence
  Description of Artificial Sequence: Synthetic oligonucleotide
  Description of Combined DNA/RNA Molecule: Synthetic oligonucleotide
gcuacuccucuuuuccugatt

SEQ ID NO: 1849 - DNA, 21 bp, Artificial Sequence
  Description of Artificial Sequence: Synthetic oligonucleotide
  Description of Combined DNA/RNA Molecule: Synthetic oligonucleotide
cucuuuuccugaagccuggtt

SEQ ID NO: 1850 - DNA, 21 bp, Artificial Sequence
  Description of Artificial Sequence: Synthetic oligonucleotide
  Description of Combined DNA/RNA Molecule: Synthetic oligonucleotide
ccugggauuccauaucccatt

SEQ ID NO: 1851 - DNA, 21 bp, Artificial Sequence
  Description of Artificial Sequence: Synthetic oligonucleotide
  Description of Combined DNA/RNA Molecule: Synthetic oligonucleotide
cauaucccaucaaggugcatt

SEQ ID NO: 1852 - DNA, 21 bp, Artificial Sequence
  Description of Artificial Sequence: Synthetic oligonucleotide
  Description of Combined DNA/RNA Molecule: Synthetic oligonucleotide
ccaucaaggugcagguuaatt

SEQ ID NO: 1853 - DNA, 21 bp, Artificial Sequence
  Description of Artificial Sequence: Synthetic oligonucleotide
  Description of Combined DNA/RNA Molecule: Synthetic oligonucleotide
cagguuaaagauucgcuugtt

SEQ ID NO: 1854 - DNA, 21 bp, Artificial Sequence
  Description of Artificial Sequence: Synthetic oligonucleotide
  Description of Combined DNA/RNA Molecule: Synthetic oligonucleotide
uucgcuugaccaguugguatt

SEQ ID NO: 1855 - DNA, 21 bp, Artificial Sequence
  Description of Artificial Sequence: Synthetic oligonucleotide
  Description of Combined DNA/RNA Molecule: Synthetic oligonucleotide
ccaguugguaggaggaguctt

SEQ ID NO: 1856 - DNA, 21 bp, Artificial Sequence
  Description of Artificial Sequence: Synthetic oligonucleotide
  Description of Combined DNA/RNA Molecule: Synthetic oligonucleotide
ggaggagucccaguaacactt

SEQ ID NO: 1857 - DNA, 21 bp, Artificial Sequence
  Description of Artificial Sequence: Synthetic oligonucleotide
  Description of Combined DNA/RNA Molecule: Synthetic oligonucleotide
caguaacacugaaugcacatt

SEQ ID NO: 1858 - DNA, 21 bp, Artificial Sequence
  Description of Artificial Sequence: Synthetic oligonucleotide
  Description of Combined DNA/RNA Molecule: Synthetic oligonucleotide
gaaugcacaaacaauugautt

SEQ ID NO: 1859 - DNA, 21 bp, Artificial Sequence
  Description of Artificial Sequence: Synthetic oligonucleotide
  Description of Combined DNA/RNA Molecule: Synthetic oligonucleotide
aacaauugauguaaaccaatt

SEQ ID NO: 1860 - DNA, 21 bp, Artificial Sequence
  Description of Artificial Sequence: Synthetic oligonucleotide
  Description of Combined DNA/RNA Molecule: Synthetic oligonucleotide
uaaaccaagagacaucugatt

SEQ ID NO: 1861 - DNA, 21 bp, Artificial Sequence
  Description of Artificial Sequence: Synthetic oligonucleotide
  Description of Combined DNA/RNA Molecule: Synthetic oligonucleotide
caucugacuuggauccaagtt

SEQ ID NO: 1862 - DNA, 21 bp, Artificial Sequence
  Description of Artificial Sequence: Synthetic oligonucleotide
  Description of Combined DNA/RNA Molecule: Synthetic oligonucleotide
gauccaagcaaaaguguaatt

SEQ ID NO: 1863 - DNA, 21 bp, Artificial Sequence
  Description of Artificial Sequence: Synthetic oligonucleotide
  Description of Combined DNA/RNA Molecule: Synthetic oligonucleotide
caaaaguguaacacguguutt

SEQ ID NO: 1864 - DNA, 21 bp, Artificial Sequence
  Description of Artificial Sequence: Synthetic oligonucleotide
  Description of Combined DNA/RNA Molecule: Synthetic oligonucleotide
aacacguguugaugauggatt

SEQ ID NO: 1865 - DNA, 21 bp, Artificial Sequence
  Description of Artificial Sequence: Synthetic oligonucleotide
  Description of Combined DNA/RNA Molecule: Synthetic oligonucleotide
ugauggaguagcuuccuuutt

SEQ ID NO: 1866 - DNA, 21 bp, Artificial Sequence
  Description of Artificial Sequence: Synthetic oligonucleotide
  Description of Combined DNA/RNA Molecule: Synthetic oligonucleotide
guagcuuccuuugugcuuatt

SEQ ID NO: 1867 - DNA, 21 bp, Artificial Sequence
  Description of Artificial Sequence: Synthetic oligonucleotide
  Description of Combined DNA/RNA Molecule: Synthetic oligonucleotide
gcuuaaucucccaucuggatt

SEQ ID NO: 1868 - DNA, 21 bp, Artificial Sequence
  Description of Artificial Sequence: Synthetic oligonucleotide
  Description of Combined DNA/RNA Molecule: Synthetic oligonucleotide
ccaucuggagugacggugctt

SEQ ID NO: 1869 - DNA, 21 bp, Artificial Sequence
  Description of Artificial Sequence: Synthetic oligonucleotide
  Description of Combined DNA/RNA Molecule: Synthetic oligonucleotide
ugacggugcuggaguuuaatt

SEQ ID NO: 1870 - DNA, 21 bp, Artificial Sequence
  Description of Artificial Sequence: Synthetic oligonucleotide
  Description of Combined DNA/RNA Molecule: Synthetic oligonucleotide
gcuggaguuuaaugucaaatt

SEQ ID NO: 1871 - DNA, 21 bp, Artificial Sequence
  Description of Artificial Sequence: Synthetic oligonucleotide
  Description of Combined DNA/RNA Molecule: Synthetic oligonucleotide
ugucaaaacugaugcuccatt

SEQ ID NO: 1872 - DNA, 21 bp, Artificial Sequence
  Description of Artificial Sequence: Synthetic oligonucleotide
  Description of Combined DNA/RNA Molecule: Synthetic oligonucleotide
gaugcuccagaucuuccagtt

SEQ ID NO: 1873 - DNA, 21 bp, Artificial Sequence
  Description of Artificial Sequence: Synthetic oligonucleotide
  Description of Combined DNA/RNA Molecule: Synthetic oligonucleotide
cagaucuuccagaagaaaatt

SEQ ID NO: 1874 - DNA, 21 bp, Artificial Sequence
  Description of Artificial Sequence: Synthetic oligonucleotide
  Description of Combined DNA/RNA Molecule: Synthetic oligonucleotide
agaaaaucaggccagggaatt

SEQ ID NO: 1875 - DNA, 21 bp, Artificial Sequence
  Description of Artificial Sequence: Synthetic oligonucleotide
  Description of Combined DNA/RNA Molecule: Synthetic oligonucleotide
ggccagggaagguuaccgatt

SEQ ID NO: 1876 - DNA, 21 bp, Artificial Sequence
  Description of Artificial Sequence: Synthetic oligonucleotide
  Description of Combined DNA/RNA Molecule: Synthetic oligonucleotide
guuaccgagcaauagcauatt

SEQ ID NO: 1877 - DNA, 21 bp, Artificial Sequence
  Description of Artificial Sequence: Synthetic oligonucleotide
  Description of Combined DNA/RNA Molecule: Synthetic oligonucleotide
auagcauacucaucucucatt

SEQ ID NO: 1878 - DNA, 21 bp, Artificial Sequence
  Description of Artificial Sequence: Synthetic oligonucleotide
  Description of Combined DNA/RNA Molecule: Synthetic oligonucleotide
uacucaucucucagccaaatt

SEQ ID NO: 1879 - DNA, 21 bp, Artificial Sequence
  Description of Artificial Sequence: Synthetic oligonucleotide
  Description of Combined DNA/RNA Molecule: Synthetic oligonucleotide
gccaaaguuaccuuuauautt

SEQ ID NO: 1880 - DNA, 21 bp, Artificial Sequence
  Description of Artificial Sequence: Synthetic oligonucleotide
  Description of Combined DNA/RNA Molecule: Synthetic oligonucleotide
ccuuuauauugauuggacutt

SEQ ID NO: 1881 - DNA, 21 bp, Artificial Sequence
  Description of Artificial Sequence: Synthetic oligonucleotide
  Description of Combined DNA/RNA Molecule: Synthetic oligonucleotide
gauuggacugauaaccauatt

SEQ ID NO: 1882 - DNA, 21 bp, Artificial Sequence
  Description of Artificial Sequence: Synthetic oligonucleotide
  Description of Combined DNA/RNA Molecule: Synthetic oligonucleotide
cugauaaccauaaggcuuutt

SEQ ID NO: 1883 - DNA, 21 bp, Artificial Sequence
  Description of Artificial Sequence: Synthetic oligonucleotide
  Description of Combined DNA/RNA Molecule: Synthetic oligonucleotide
aggcuuugcuagugggagatt

SEQ ID NO: 1884 - DNA, 21 bp, Artificial Sequence
  Description of Artificial Sequence: Synthetic oligonucleotide
  Description of Combined DNA/RNA Molecule: Synthetic oligonucleotide
gugggagaacaucugaauatt

SEQ ID NO: 1885 - DNA, 21 bp, Artificial Sequence
  Description of Artificial Sequence: Synthetic oligonucleotide
  Description of Combined DNA/RNA Molecule: Synthetic oligonucleotide
caucugaauauuauuguuatt

SEQ ID NO: 1886 - DNA, 21 bp, Artificial Sequence
  Description of Artificial Sequence: Synthetic oligonucleotide
  Description of Combined DNA/RNA Molecule: Synthetic oligonucleotide
uauuauuguuacccccaaatt

SEQ ID NO: 1887 - DNA, 21 bp, Artificial Sequence
  Description of Artificial Sequence: Synthetic oligonucleotide
  Description of Combined DNA/RNA Molecule: Synthetic oligonucleotide
cccaaaagcccauauauugtt

SEQ ID NO: 1888 - DNA, 21 bp, Artificial Sequence
  Description of Artificial Sequence: Synthetic oligonucleotide
  Description of Combined DNA/RNA Molecule: Synthetic oligonucleotide
ccaaaagcccauauauugatt

SEQ ID NO: 1889 - DNA, 21 bp, Artificial Sequence
  Description of Artificial Sequence: Synthetic oligonucleotide
  Description of Combined DNA/RNA Molecule: Synthetic oligonucleotide
caaaagcccauauauugactt

SEQ ID NO: 1890 - DNA, 21 bp, Artificial Sequence
  Description of Artificial Sequence: Synthetic oligonucleotide
  Description of Combined DNA/RNA Molecule: Synthetic oligonucleotide
aaaagcccauauauugacatt

SEQ ID NO: 1891 - DNA, 21 bp, Artificial Sequence
  Description of Artificial Sequence: Synthetic oligonucleotide
  Description of Combined DNA/RNA Molecule: Synthetic oligonucleotide
aaagcccauauauugacaatt

SEQ ID NO: 1892 - DNA, 21 bp, Artificial Sequence
  Description of Artificial Sequence: Synthetic oligonucleotide
  Description of Combined DNA/RNA Molecule: Synthetic oligonucleotide
aagcccauauauugacaaatt

SEQ ID NO: 1893 - DNA, 21 bp, Artificial Sequence
  Description of Artificial Sequence: Synthetic oligonucleotide
  Description of Combined DNA/RNA Molecule: Synthetic oligonucleotide
agcccauauauugacaaaatt

SEQ ID NO: 1894 - DNA, 21 bp, Artificial Sequence
  Description of Artificial Sequence: Synthetic oligonucleotide
  Description of Combined DNA/RNA Molecule: Synthetic oligonucleotide
gcccauauauugacaaaautt

SEQ ID NO: 1895 - DNA, 21 bp, Artificial Sequence
  Description of Artificial Sequence: Synthetic oligonucleotide
  Description of Combined DNA/RNA Molecule: Synthetic oligonucleotide
cccauauauugacaaaauatt

SEQ ID NO: 1896 - DNA, 21 bp, Artificial Sequence
  Description of Artificial Sequence: Synthetic oligonucleotide
  Description of Combined DNA/RNA Molecule: Synthetic oligonucleotide
ccauauauugacaaaauaatt

SEQ ID NO: 1897 - DNA, 21 bp, Artificial Sequence
  Description of Artificial Sequence: Synthetic oligonucleotide
  Description of Combined DNA/RNA Molecule: Synthetic oligonucleotide
cauauauugacaaaauaactt

SEQ ID NO: 1898 - DNA, 21 bp, Artificial Sequence
  Description of Artificial Sequence: Synthetic oligonucleotide
  Description of Combined DNA/RNA Molecule: Synthetic oligonucleotide
auauauugacaaaauaacutt

SEQ ID NO: 1899 - DNA, 21 bp, Artificial Sequence
  Description of Artificial Sequence: Synthetic oligonucleotide
  Description of Combined DNA/RNA Molecule: Synthetic oligonucleotide
uauauugacaaaauaacuctt

SEQ ID NO: 1900 - DNA, 21 bp, Artificial Sequence
  Description of Artificial Sequence: Synthetic oligonucleotide
  Description of Combined DNA/RNA Molecule: Synthetic oligonucleotide
auauugacaaaauaacucatt

SEQ ID NO: 1901 - DNA, 21 bp, Artificial Sequence
  Description of Artificial Sequence: Synthetic oligonucleotide
  Description of Combined DNA/RNA Molecule: Synthetic oligonucleotide
uauugacaaaauaacucactt

SEQ ID NO: 1902 - DNA, 21 bp, Artificial Sequence
  Description of Artificial Sequence: Synthetic oligonucleotide
  Description of Combined DNA/RNA Molecule: Synthetic oligonucleotide
auugacaaaauaacucacutt

SEQ ID NO: 1903 - DNA, 21 bp, Artificial Sequence
  Description of Artificial Sequence: Synthetic oligonucleotide
  Description of Combined DNA/RNA Molecule: Synthetic oligonucleotide
uugacaaaauaacucacuatt

SEQ ID NO: 1904 - DNA, 21 bp, Artificial Sequence
  Description of Artificial Sequence: Synthetic oligonucleotide
  Description of Combined DNA/RNA Molecule: Synthetic oligonucleotide
ugacaaaauaacucacuautt

SEQ ID NO: 1905 - DNA, 21 bp, Artificial Sequence
  Description of Artificial Sequence: Synthetic oligonucleotide
  Description of Combined DNA/RNA Molecule: Synthetic oligonucleotide
gacaaaauaacucacuauatt

SEQ ID NO: 1906 - DNA, 21 bp, Artificial Sequence
  Description of Artificial Sequence: Synthetic oligonucleotide
  Description of Combined DNA/RNA Molecule: Synthetic oligonucleotide
aaaauaacucacuauaauutt

SEQ ID NO: 1907 - DNA, 21 bp, Artificial Sequence
  Description of Artificial Sequence: Synthetic oligonucleotide
  Description of Combined DNA/RNA Molecule: Synthetic oligonucleotide
aaauaacucacuauaauuatt

SEQ ID NO: 1908 - DNA, 21 bp, Artificial Sequence
  Description of Artificial Sequence: Synthetic oligonucleotide
  Description of Combined DNA/RNA Molecule: Synthetic oligonucleotide
aauaacucacuauaauuactt

SEQ ID NO: 1909 - DNA, 21 bp, Artificial Sequence
  Description of Artificial Sequence: Synthetic oligonucleotide
  Description of Combined DNA/RNA Molecule: Synthetic oligonucleotide
auaacucacuauaauuacutt

SEQ ID NO: 1910 - DNA, 21 bp, Artificial Sequence
  Description of Artificial Sequence: Synthetic oligonucleotide
  Description of Combined DNA/RNA Molecule: Synthetic oligonucleotide
aacucacuauaauuacuugtt

SEQ ID NO: 1911 - DNA, 21 bp, Artificial Sequence
  Description of Artificial Sequence: Synthetic oligonucleotide
  Description of Combined DNA/RNA Molecule: Synthetic oligonucleotide
acucacuauaauuacuugatt

SEQ ID NO: 1912 - DNA, 21 bp, Artificial Sequence
  Description of Artificial Sequence: Synthetic oligonucleotide
  Description of Combined DNA/RNA Molecule: Synthetic oligonucleotide
cucacuauaauuacuugautt

SEQ ID NO: 1913 - DNA, 21 bp, Artificial Sequence
  Description of Artificial Sequence: Synthetic oligonucleotide
  Description of Combined DNA/RNA Molecule: Synthetic oligonucleotide
ucacuauaauuacuugauutt

SEQ ID NO: 1914 - DNA, 21 bp, Artificial Sequence
  Description of Artificial Sequence: Synthetic oligonucleotide
  Description of Combined DNA/RNA Molecule: Synthetic oligonucleotide
acuauaauuacuugauuuutt

SEQ ID NO: 1915 - DNA, 21 bp, Artificial Sequence
  Description of Artificial Sequence: Synthetic oligonucleotide
  Description of Combined DNA/RNA Molecule: Synthetic oligonucleotide
cuauaauuacuugauuuuatt

SEQ ID NO: 1916 - DNA, 21 bp, Artificial Sequence
  Description of Artificial Sequence: Synthetic oligonucleotide
  Description of Combined DNA/RNA Molecule: Synthetic oligonucleotide
uauaauuacuugauuuuautt

SEQ ID NO: 1917 - DNA, 21 bp, Artificial Sequence
  Description of Artificial Sequence: Synthetic oligonucleotide
  Description of Combined DNA/RNA Molecule: Synthetic oligonucleotide
auaauuacuugauuuuauctt

SEQ ID NO: 1918 - DNA, 21 bp, Artificial Sequence
  Description of Artificial Sequence: Synthetic oligonucleotide
  Description of Combined DNA/RNA Molecule: Synthetic oligonucleotide
uaauuacuugauuuuaucctt

SEQ ID NO: 1919 - DNA, 21 bp, Artificial Sequence
  Description of Artificial Sequence: Synthetic oligonucleotide
  Description of Combined DNA/RNA Molecule: Synthetic oligonucleotide
aauuacuugauuuuauccatt

SEQ ID NO: 1920 - DNA, 21 bp, Artificial Sequence
  Description of Artificial Sequence: Synthetic oligonucleotide
  Description of Combined DNA/RNA Molecule: Synthetic oligonucleotide
auuacuugauuuuauccaatt

SEQ ID NO: 1921 - DNA, 21 bp, Artificial Sequence
  Description of Artificial Sequence: Synthetic oligonucleotide
  Description of Combined DNA/RNA Molecule: Synthetic oligonucleotide
uuauccaagggcaaaauuatt

SEQ ID NO: 1922 - DNA, 21 bp, Artificial Sequence
  Description of Artificial Sequence: Synthetic oligonucleotide
  Description of Combined DNA/RNA Molecule: Synthetic oligonucleotide
gcaaaauuauccacuuuggtt

SEQ ID NO: 1923 - DNA, 21 bp, Artificial Sequence
  Description of Artificial Sequence: Synthetic oligonucleotide
  Description of Combined DNA/RNA Molecule: Synthetic oligonucleotide
cacuuuggcacgagggagatt

SEQ ID NO: 1924 - DNA, 21 bp, Artificial Sequence
  Description of Artificial Sequence: Synthetic oligonucleotide
  Description of Combined DNA/RNA Molecule: Synthetic oligonucleotide
cgagggagaaauuuucagatt

SEQ ID NO: 1925 - DNA, 21 bp, Artificial Sequence
  Description of Artificial Sequence: Synthetic oligonucleotide
  Description of Combined DNA/RNA Molecule: Synthetic oligonucleotide
auuuucagaugcaucuuautt

SEQ ID NO: 1926 - DNA, 21 bp, Artificial Sequence
  Description of Artificial Sequence: Synthetic oligonucleotide
  Description of Combined DNA/RNA Molecule: Synthetic oligonucleotide
gcaucuuaucaaaguauaatt

SEQ ID NO: 1927 - DNA, 21 bp, Artificial Sequence
  Description of Artificial Sequence: Synthetic oligonucleotide
  Description of Combined DNA/RNA Molecule: Synthetic oligonucleotide
caaaguauaaacauuccagtt

SEQ ID NO: 1928 - DNA, 21 bp, Artificial Sequence
  Description of Artificial Sequence: Synthetic oligonucleotide
  Description of Combined DNA/RNA Molecule: Synthetic oligonucleotide
auuccaguaacacagaacatt

SEQ ID NO: 1929 - DNA, 21 bp, Artificial Sequence
  Description of Artificial Sequence: Synthetic oligonucleotide
  Description of Combined DNA/RNA Molecule: Synthetic oligonucleotide
cacagaacaugguuccuuctt

SEQ ID NO: 1930 - DNA, 21 bp, Artificial Sequence
  Description of Artificial Sequence: Synthetic oligonucleotide
  Description of Combined DNA/RNA Molecule: Synthetic oligonucleotide
gguuccuucaucccgacuutt

SEQ ID NO: 1931 - DNA, 21 bp, Artificial Sequence
  Description of Artificial Sequence: Synthetic oligonucleotide
  Description of Combined DNA/RNA Molecule: Synthetic oligonucleotide
cccgacuucuggucuauuatt

SEQ ID NO: 1932 - DNA, 21 bp, Artificial Sequence
  Description of Artificial Sequence: Synthetic oligonucleotide
  Description of Combined DNA/RNA Molecule: Synthetic oligonucleotide
ggucuauuacaucgucacatt

SEQ ID NO: 1933 - DNA, 21 bp, Artificial Sequence
  Description of Artificial Sequence: Synthetic oligonucleotide
  Description of Combined DNA/RNA Molecule: Synthetic oligonucleotide
aucgucacaggagaacagatt

SEQ ID NO: 1934 - DNA, 21 bp, Artificial Sequence
  Description of Artificial Sequence: Synthetic oligonucleotide
  Description of Combined DNA/RNA Molecule: Synthetic oligonucleotide
caggagaacagacagcagatt

SEQ ID NO: 1935 - DNA, 21 bp, Artificial Sequence
  Description of Artificial Sequence: Synthetic oligonucleotide
  Description of Combined DNA/RNA Molecule: Synthetic oligonucleotide
cagcagaauuagugucugatt

SEQ ID NO: 1936 - DNA, 21 bp, Artificial Sequence
  Description of Artificial Sequence: Synthetic oligonucleotide
  Description of Combined DNA/RNA Molecule: Synthetic oligonucleotide
gugucugauucagucuggutt

SEQ ID NO: 1937 - DNA, 21 bp, Artificial Sequence
  Description of Artificial Sequence: Synthetic oligonucleotide
  Description of Combined DNA/RNA Molecule: Synthetic oligonucleotide
cagucugguuaaauauugatt

SEQ ID NO: 1938 - DNA, 21 bp, Artificial Sequence
  Description of Artificial Sequence: Synthetic oligonucleotide
  Description of Combined DNA/RNA Molecule: Synthetic oligonucleotide
guuaaauauugaagaaaaatt

SEQ ID NO: 1939 - DNA, 21 bp, Artificial Sequence
  Description of Artificial Sequence: Synthetic oligonucleotide
  Description of Combined DNA/RNA Molecule: Synthetic oligonucleotide
agaaaaauguggcaaccagtt

SEQ ID NO: 1940 - DNA, 21 bp, Artificial Sequence
  Description of Artificial Sequence: Synthetic oligonucleotide
  Description of Combined DNA/RNA Molecule: Synthetic oligonucleotide
gcaaccagcuccagguucatt

SEQ ID NO: 1941 - DNA, 21 bp, Artificial Sequence
  Description of Artificial Sequence: Synthetic oligonucleotide
  Description of Combined DNA/RNA Molecule: Synthetic oligonucleotide
gcuccagguucaucugucutt

SEQ ID NO: 1942 - DNA, 21 bp, Artificial Sequence
  Description of Artificial Sequence: Synthetic oligonucleotide
  Description of Combined DNA/RNA Molecule: Synthetic oligonucleotide
aucugucuccugaugcagatt

SEQ ID NO: 1943 - DNA, 21 bp, Artificial Sequence
  Description of Artificial Sequence: Synthetic oligonucleotide
  Description of Combined DNA/RNA Molecule: Synthetic oligonucleotide
gaugcagaugcauauucuctt

SEQ ID NO: 1944 - DNA, 21 bp, Artificial Sequence
  Description of Artificial Sequence: Synthetic oligonucleotide
  Description of Combined DNA/RNA Molecule: Synthetic oligonucleotide
gcauauucuccaggccaaatt

SEQ ID NO: 1945 - DNA, 21 bp, Artificial Sequence
  Description of Artificial Sequence: Synthetic oligonucleotide
  Description of Combined DNA/RNA Molecule: Synthetic oligonucleotide
aggccaaacugugucucuutt

SEQ ID NO: 1946 - DNA, 21 bp, Artificial Sequence
  Description of Artificial Sequence: Synthetic oligonucleotide
  Description of Combined DNA/RNA Molecule: Synthetic oligonucleotide
gugucucuuaauauggcaatt

SEQ ID NO: 1947 - DNA, 21 bp, Artificial Sequence
  Description of Artificial Sequence: Synthetic oligonucleotide
  Description of Combined DNA/RNA Molecule: Synthetic oligonucleotide
uuaauauggcaacuggaautt

SEQ ID NO: 1948 - DNA, 21 bp, Artificial Sequence
  Description of Artificial Sequence: Synthetic oligonucleotide
  Description of Combined DNA/RNA Molecule: Synthetic oligonucleotide
aacuggaauggauuccuggtt

SEQ ID NO: 1949 - DNA, 21 bp, Artificial Sequence
  Description of Artificial Sequence: Synthetic oligonucleotide
  Description of Combined DNA/RNA Molecule: Synthetic oligonucleotide
uuccuggguggcauuagcatt

SEQ ID NO: 1950 - DNA, 21 bp, Artificial Sequence
  Description of Artificial Sequence: Synthetic oligonucleotide
  Description of Combined DNA/RNA Molecule: Synthetic oligonucleotide
ggcauuagcagcaguggactt

SEQ ID NO: 1951 - DNA, 21 bp, Artificial Sequence
  Description of Artificial Sequence: Synthetic oligonucleotide
  Description of Combined DNA/RNA Molecule: Synthetic oligonucleotide
aguggacagugcuguguautt

SEQ ID NO: 1952 - DNA, 21 bp, Artificial Sequence
  Description of Artificial Sequence: Synthetic oligonucleotide
  Description of Combined DNA/RNA Molecule: Synthetic oligonucleotide
gcuguguauggaguccaaatt

SEQ ID NO: 1953 - DNA, 21 bp, Artificial Sequence
  Description of Artificial Sequence: Synthetic oligonucleotide
  Description of Combined DNA/RNA Molecule: Synthetic oligonucleotide
aguccaaagaggagccaaatt

SEQ ID NO: 1954 - DNA, 21 bp, Artificial Sequence
  Description of Artificial Sequence: Synthetic oligonucleotide
  Description of Combined DNA/RNA Molecule: Synthetic oligonucleotide
agaggagccaaaaagcccutt

SEQ ID NO: 1955 - DNA, 21 bp, Artificial Sequence
  Description of Artificial Sequence: Synthetic oligonucleotide
  Description of Combined DNA/RNA Molecule: Synthetic oligonucleotide
agcccuuggaaagaguauutt

SEQ ID NO: 1956 - DNA, 21 bp, Artificial Sequence
  Description of Artificial Sequence: Synthetic oligonucleotide
  Description of Combined DNA/RNA Molecule: Synthetic oligonucleotide
aagaguauuucaauucuuatt

SEQ ID NO: 1957 - DNA, 21 bp, Artificial Sequence
  Description of Artificial Sequence: Synthetic oligonucleotide
  Description of Combined DNA/RNA Molecule: Synthetic oligonucleotide
uuucaauucuuagagaagatt

SEQ ID NO: 1958 - DNA, 21 bp, Artificial Sequence
  Description of Artificial Sequence: Synthetic oligonucleotide
  Description of Combined DNA/RNA Molecule: Synthetic oligonucleotide
gagaagagugaucugggcutt

SEQ ID NO: 1959 - DNA, 21 bp, Artificial Sequence
  Description of Artificial Sequence: Synthetic oligonucleotide
  Description of Combined DNA/RNA Molecule: Synthetic oligonucleotide
ugaucugggcuguggggcatt

SEQ ID NO: 1960 - DNA, 21 bp, Artificial Sequence
  Description of Artificial Sequence: Synthetic oligonucleotide
  Description of Combined DNA/RNA Molecule: Synthetic oligonucleotide
ggggcaggugguggccucatt

SEQ ID NO: 1961 - DNA, 21 bp, Artificial Sequence
  Description of Artificial Sequence: Synthetic oligonucleotide
  Description of Combined DNA/RNA Molecule: Synthetic oligonucleotide
guggccucaacaaugccaatt

SEQ ID NO: 1962 - DNA, 21 bp, Artificial Sequence
  Description of Artificial Sequence: Synthetic oligonucleotide
  Description of Combined DNA/RNA Molecule: Synthetic oligonucleotide
caacaaugccaauguguuctt

SEQ ID NO: 1963 - DNA, 21 bp, Artificial Sequence
  Description of Artificial Sequence: Synthetic oligonucleotide
  Description of Combined DNA/RNA Molecule: Synthetic oligonucleotide
caauguguuccaccuagcutt

SEQ ID NO: 1964 - DNA, 21 bp, Artificial Sequence
  Description of Artificial Sequence: Synthetic oligonucleotide
  Description of Combined DNA/RNA Molecule: Synthetic oligonucleotide
caccuagcuggacuuaccutt

SEQ ID NO: 1965 - DNA, 21 bp, Artificial Sequence
  Description of Artificial Sequence: Synthetic oligonucleotide
  Description of Combined DNA/RNA Molecule: Synthetic oligonucleotide
gacuuaccuuccucacuaatt

SEQ ID NO: 1966 - DNA, 21 bp, Artificial Sequence
  Description of Artificial Sequence: Synthetic oligonucleotide
  Description of Combined DNA/RNA Molecule: Synthetic oligonucleotide
ucacuaaugcaaaugcagatt

SEQ ID NO: 1967 - DNA, 21 bp, Artificial Sequence
  Description of Artificial Sequence: Synthetic oligonucleotide
  Description of Combined DNA/RNA Molecule: Synthetic oligonucleotide
aaaugcagaugacucccaatt

SEQ ID NO: 1968 - DNA, 21 bp, Artificial Sequence
  Description of Artificial Sequence: Synthetic oligonucleotide
  Description of Combined DNA/RNA Molecule: Synthetic oligonucleotide
cucccaagaaaaugaugaatt

SEQ ID NO: 1969 - DNA, 21 bp, Artificial Sequence
  Description of Artificial Sequence: Synthetic oligonucleotide
  Description of Combined DNA/RNA Molecule: Synthetic oligonucleotide
ccuuguaaagaaauucucatt

SEQ ID NO: 1970 - DNA, 21 bp, Artificial Sequence
  Description of Artificial Sequence: Synthetic oligonucleotide
  Description of Combined DNA/RNA Molecule: Synthetic oligonucleotide
aauucucaggccaagaagatt

SEQ ID NO: 1971 - DNA, 21 bp, Artificial Sequence
  Description of Artificial Sequence: Synthetic oligonucleotide
  Description of Combined DNA/RNA Molecule: Synthetic oligonucleotide
ccaagaagaacgcugcaaatt

SEQ ID NO: 1972 - DNA, 21 bp, Artificial Sequence
  Description of Artificial Sequence: Synthetic oligonucleotide
  Description of Combined DNA/RNA Molecule: Synthetic oligonucleotide
cgcugcaaaagaagauagatt

SEQ ID NO: 1973 - DNA, 21 bp, Artificial Sequence
  Description of Artificial Sequence: Synthetic oligonucleotide
  Description of Combined DNA/RNA Molecule: Synthetic oligonucleotide
aaagaagauagaagaaauatt

SEQ ID NO: 1974 - DNA, 21 bp, Artificial Sequence
  Description of Artificial Sequence: Synthetic oligonucleotide
  Description of Combined DNA/RNA Molecule: Synthetic oligonucleotide
agaaauagcugcuaaauautt

SEQ ID NO: 1975 - DNA, 21 bp, Artificial Sequence
  Description of Artificial Sequence: Synthetic oligonucleotide
  Description of Combined DNA/RNA Molecule: Synthetic oligonucleotide
gcugcuaaauauaaacauutt

SEQ ID NO: 1976 - DNA, 21 bp, Artificial Sequence
  Description of Artificial Sequence: Synthetic oligonucleotide
  Description of Combined DNA/RNA Molecule: Synthetic oligonucleotide
acauucaguagugaagaaatt

SEQ ID NO: 1977 - DNA, 21 bp, Artificial Sequence
  Description of Artificial Sequence: Synthetic oligonucleotide
  Description of Combined DNA/RNA Molecule: Synthetic oligonucleotide
guagugaagaaauguuguutt

SEQ ID NO: 1978 - DNA, 21 bp, Artificial Sequence
  Description of Artificial Sequence: Synthetic oligonucleotide
  Description of Combined DNA/RNA Molecule: Synthetic oligonucleotide
aaauguuguuacgauggagtt

SEQ ID NO: 1979 - DNA, 21 bp, Artificial Sequence
  Description of Artificial Sequence: Synthetic oligonucleotide
  Description of Combined DNA/RNA Molecule: Synthetic oligonucleotide
cgauggagccugcguuaautt

SEQ ID NO: 1980 - DNA, 21 bp, Artificial Sequence
  Description of Artificial Sequence: Synthetic oligonucleotide
  Description of Combined DNA/RNA Molecule: Synthetic oligonucleotide
cguuaauaaugaugaaacctt

SEQ ID NO: 1981 - DNA, 21 bp, Artificial Sequence
  Description of Artificial Sequence: Synthetic oligonucleotide
  Description of Combined DNA/RNA Molecule: Synthetic oligonucleotide
augaugaaaccugugagcatt

SEQ ID NO: 1982 - DNA, 21 bp, Artificial Sequence
  Description of Artificial Sequence: Synthetic oligonucleotide
  Description of Combined DNA/RNA Molecule: Synthetic oligonucleotide
cugugagcagcgagcugcatt

SEQ ID NO: 1983 - DNA, 21 bp, Artificial Sequence
  Description of Artificial Sequence: Synthetic oligonucleotide
  Description of Combined DNA/RNA Molecule: Synthetic oligonucleotide
cgagcugcacggauuaguutt

SEQ ID NO: 1984 - DNA, 21 bp, Artificial Sequence
  Description of Artificial Sequence: Synthetic oligonucleotide
  Description of Combined DNA/RNA Molecule: Synthetic oligonucleotide
ggauuaguuuagggccaagtt

SEQ ID NO: 1985 - DNA, 21 bp, Artificial Sequence
  Description of Artificial Sequence: Synthetic oligonucleotide
  Description of Combined DNA/RNA Molecule: Synthetic oligonucleotide
gggccaagaugcaucaaagtt

SEQ ID NO: 1986 - DNA, 21 bp, Artificial Sequence
  Description of Artificial Sequence: Synthetic oligonucleotide
  Description of Combined DNA/RNA Molecule: Synthetic oligonucleotide
caucaaagcuuucacugaatt

SEQ ID NO: 1987 - DNA, 21 bp, Artificial Sequence
  Description of Artificial Sequence: Synthetic oligonucleotide
  Description of Combined DNA/RNA Molecule: Synthetic oligonucleotide
gcuuucacugaauguugugtt

SEQ ID NO: 1988 - DNA, 21 bp, Artificial Sequence
  Description of Artificial Sequence: Synthetic oligonucleotide
  Description of Combined DNA/RNA Molecule: Synthetic oligonucleotide
aauguugugucgucgcaagtt

SEQ ID NO: 1989 - DNA, 21 bp, Artificial Sequence
  Description of Artificial Sequence: Synthetic oligonucleotide
  Description of Combined DNA/RNA Molecule: Synthetic oligonucleotide
cgucgcaagccagcuccgutt

SEQ ID NO: 1990 - DNA, 21 bp, Artificial Sequence
  Description of Artificial Sequence: Synthetic oligonucleotide
  Description of Combined DNA/RNA Molecule: Synthetic oligonucleotide
gcuccgugcuaauaucucutt

SEQ ID NO: 1991 - DNA, 21 bp, Artificial Sequence
  Description of Artificial Sequence: Synthetic oligonucleotide
  Description of Combined DNA/RNA Molecule: Synthetic oligonucleotide
cuaauaucucucauaaagatt

SEQ ID NO: 1992 - DNA, 21 bp, Artificial Sequence
  Description of Artificial Sequence: Synthetic oligonucleotide
  Description of Combined DNA/RNA Molecule: Synthetic oligonucleotide
aaagacaugcaauugggaatt

SEQ ID NO: 1993 - DNA, 21 bp, Artificial Sequence
  Description of Artificial Sequence: Synthetic oligonucleotide
  Description of Combined DNA/RNA Molecule: Synthetic oligonucleotide
caauugggaaggcuacacatt

SEQ ID NO: 1994 - DNA, 21 bp, Artificial Sequence
  Description of Artificial Sequence: Synthetic oligonucleotide
  Description of Combined DNA/RNA Molecule: Synthetic oligonucleotide
gcuacacaugaagacccugtt

SEQ ID NO: 1995 - DNA, 21 bp, Artificial Sequence
  Description of Artificial Sequence: Synthetic oligonucleotide
  Description of Combined DNA/RNA Molecule: Synthetic oligonucleotide
caugaagacccuguuaccatt

SEQ ID NO: 1996 - DNA, 21 bp, Artificial Sequence
  Description of Artificial Sequence: Synthetic oligonucleotide
  Description of Combined DNA/RNA Molecule: Synthetic oligonucleotide
uaccaguaagcaagccagatt

SEQ ID NO: 1997 - DNA, 21 bp, Artificial Sequence
  Description of Artificial Sequence: Synthetic oligonucleotide
  Description of Combined DNA/RNA Molecule: Synthetic oligonucleotide
agcaagccagaaauucggatt

SEQ ID NO: 1998 - DNA, 21 bp, Artificial Sequence
  Description of Artificial Sequence: Synthetic oligonucleotide
  Description of Combined DNA/RNA Molecule: Synthetic oligonucleotide
agaaauucggaguuauuuutt

SEQ ID NO: 1999 - DNA, 21 bp, Artificial Sequence
  Description of Artificial Sequence: Synthetic oligonucleotide
  Description of Combined DNA/RNA Molecule: Synthetic oligonucleotide
aguuauuuuccagaaagcutt

SEQ ID NO: 2000 - DNA, 21 bp, Artificial Sequence
  Description of Artificial Sequence: Synthetic oligonucleotide
  Description of Combined DNA/RNA Molecule: Synthetic oligonucleotide
cagaaagcugguugugggatt

SEQ ID NO: 2001 - DNA, 21 bp, Artificial Sequence
  Description of Artificial Sequence: Synthetic oligonucleotide
  Description of Combined DNA/RNA Molecule: Synthetic oligonucleotide
gugggaaguucaucuuguutt

SEQ ID NO: 2002 - DNA, 21 bp, Artificial Sequence
  Description of Artificial Sequence: Synthetic oligonucleotide
  Description of Combined DNA/RNA Molecule: Synthetic oligonucleotide
ucaucuuguucccagaagatt

SEQ ID NO: 2003 - DNA, 21 bp, Artificial Sequence
  Description of Artificial Sequence: Synthetic oligonucleotide
  Description of Combined DNA/RNA Molecule: Synthetic oligonucleotide
ccagaagaaaacaguugcatt

SEQ ID NO: 2004 - DNA, 21 bp, Artificial Sequence
  Description of Artificial Sequence: Synthetic oligonucleotide
  Description of Combined DNA/RNA Molecule: Synthetic oligonucleotide
caguugcaguuugcccuactt

SEQ ID NO: 2005 - DNA, 21 bp, Artificial Sequence
  Description of Artificial Sequence: Synthetic oligonucleotide
  Description of Combined DNA/RNA Molecule: Synthetic oligonucleotide
caguuugcccuaccugauutt

SEQ ID NO: 2006 - DNA, 21 bp, Artificial Sequence
  Description of Artificial Sequence: Synthetic oligonucleotide
  Description of Combined DNA/RNA Molecule: Synthetic oligonucleotide
ccugauucucuaaccaccutt

SEQ ID NO: 2007 - DNA, 21 bp, Artificial Sequence
  Description of Artificial Sequence: Synthetic oligonucleotide
  Description of Combined DNA/RNA Molecule: Synthetic oligonucleotide
accaccugggaaauucaagtt

SEQ ID NO: 2008 - DNA, 21 bp, Artificial Sequence
  Description of Artificial Sequence: Synthetic oligonucleotide
  Description of Combined DNA/RNA Molecule: Synthetic oligonucleotide
gaaauucaaggcguuggcatt

SEQ ID NO: 2009 - DNA, 21 bp, Artificial Sequence
  Description of Artificial Sequence: Synthetic oligonucleotide
  Description of Combined DNA/RNA Molecule: Synthetic oligonucleotide
cguuggcauuucaaacacutt

SEQ ID NO: 2010 - DNA, 21 bp, Artificial Sequence
  Description of Artificial Sequence: Synthetic oligonucleotide
  Description of Combined DNA/RNA Molecule: Synthetic oligonucleotide
cauuucaaacacugguauatt

SEQ ID NO: 2011 - DNA, 21 bp, Artificial Sequence
  Description of Artificial Sequence: Synthetic oligonucleotide
  Description of Combined DNA/RNA Molecule: Synthetic oligonucleotide
guauauguguugcugauactt

SEQ ID NO: 2012 - DNA, 21 bp, Artificial Sequence
  Description of Artificial Sequence: Synthetic oligonucleotide
  Description of Combined DNA/RNA Molecule: Synthetic oligonucleotide
ugcugauacugucaaggcatt

SEQ ID NO: 2013 - DNA, 21 bp, Artificial Sequence
  Description of Artificial Sequence: Synthetic oligonucleotide
  Description of Combined DNA/RNA Molecule: Synthetic oligonucleotide
cugucaaggcaaagguguutt

SEQ ID NO: 2014 - DNA, 21 bp, Artificial Sequence
  Description of Artificial Sequence: Synthetic oligonucleotide
  Description of Combined DNA/RNA Molecule: Synthetic oligonucleotide
agguguucaaagaugucuutt

SEQ ID NO: 2015 - DNA, 21 bp, Artificial Sequence
  Description of Artificial Sequence: Synthetic oligonucleotide
  Description of Combined DNA/RNA Molecule: Synthetic oligonucleotide
caaagaugucuuccuggaatt

SEQ ID NO: 2016 - DNA, 21 bp, Artificial Sequence
  Description of Artificial Sequence: Synthetic oligonucleotide
  Description of Combined DNA/RNA Molecule: Synthetic oligonucleotide
cuuccuggaaaugaauauatt

SEQ ID NO: 2017 - DNA, 21 bp, Artificial Sequence
  Description of Artificial Sequence: Synthetic oligonucleotide
  Description of Combined DNA/RNA Molecule: Synthetic oligonucleotide
gaauauaccauauucuguutt

SEQ ID NO: 2018 - DNA, 21 bp, Artificial Sequence
  Description of Artificial Sequence: Synthetic oligonucleotide
  Description of Combined DNA/RNA Molecule: Synthetic oligonucleotide
auauucuguuguacgaggatt

SEQ ID NO: 2019 - DNA, 21 bp, Artificial Sequence
  Description of Artificial Sequence: Synthetic oligonucleotide
  Description of Combined DNA/RNA Molecule: Synthetic oligonucleotide
cgaggagaacagauccaautt

SEQ ID NO: 2020 - DNA, 21 bp, Artificial Sequence
  Description of Artificial Sequence: Synthetic oligonucleotide
  Description of Combined DNA/RNA Molecule: Synthetic oligonucleotide
gaacagauccaauugaaagtt

SEQ ID NO: 2021 - DNA, 21 bp, Artificial Sequence
  Description of Artificial Sequence: Synthetic oligonucleotide
  Description of Combined DNA/RNA Molecule: Synthetic oligonucleotide
gaaaggaacuguuuacaactt

SEQ ID NO: 2022 - DNA, 21 bp, Artificial Sequence
  Description of Artificial Sequence: Synthetic oligonucleotide
  Description of Combined DNA/RNA Molecule: Synthetic oligonucleotide
acuguuuacaacuauaggatt

SEQ ID NO: 2023 - DNA, 21 bp, Artificial Sequence
  Description of Artificial Sequence: Synthetic oligonucleotide
  Description of Combined DNA/RNA Molecule: Synthetic oligonucleotide
aacuauaggacuucugggatt

SEQ ID NO: 2024 - DNA, 21 bp, Artificial Sequence
  Description of Artificial Sequence: Synthetic oligonucleotide
  Description of Combined DNA/RNA Molecule: Synthetic oligonucleotide
ugggaugcaguucuguguutt

SEQ ID NO: 2025 - DNA, 21 bp, Artificial Sequence
  Description of Artificial Sequence: Synthetic oligonucleotide
  Description of Combined DNA/RNA Molecule: Synthetic oligonucleotide
guucuguguuaaaaugucutt

SEQ ID NO: 2026 - DNA, 21 bp, Artificial Sequence
  Description of Artificial Sequence: Synthetic oligonucleotide
  Description of Combined DNA/RNA Molecule: Synthetic oligonucleotide
uuaaaaugucugcuguggatt

SEQ ID NO: 2027 - DNA, 21 bp, Artificial Sequence
  Description of Artificial Sequence: Synthetic oligonucleotide
  Description of Combined DNA/RNA Molecule: Synthetic oligonucleotide
cuguggagggaaucugcactt

SEQ ID NO: 2028 - DNA, 21 bp, Artificial Sequence
  Description of Artificial Sequence: Synthetic oligonucleotide
  Description of Combined DNA/RNA Molecule: Synthetic oligonucleotide
ggaaucugcacuucggaaatt

SEQ ID NO: 2029 - DNA, 21 bp, Artificial Sequence
  Description of Artificial Sequence: Synthetic oligonucleotide
  Description of Combined DNA/RNA Molecule: Synthetic oligonucleotide
cggaaagcccagucauugatt

SEQ ID NO: 2030 - DNA, 21 bp, Artificial Sequence
  Description of Artificial Sequence: Synthetic oligonucleotide
  Description of Combined DNA/RNA Molecule: Synthetic oligonucleotide
ccagucauugaucaucaggtt

SEQ ID NO: 2031 - DNA, 21 bp, Artificial Sequence
  Description of Artificial Sequence: Synthetic oligonucleotide
  Description of Combined DNA/RNA Molecule: Synthetic oligonucleotide
caucagggcacaaaguccutt

SEQ ID NO: 2032 - DNA, 21 bp, Artificial Sequence
  Description of Artificial Sequence: Synthetic oligonucleotide
  Description of Combined DNA/RNA Molecule: Synthetic oligonucleotide
ggcacaaaguccuccaaautt

SEQ ID NO: 2033 - DNA, 21 bp, Artificial Sequence
  Description of Artificial Sequence: Synthetic oligonucleotide
  Description of Combined DNA/RNA Molecule: Synthetic oligonucleotide
caaaugugugcgccagaaatt

SEQ ID NO: 2034 - DNA, 21 bp, Artificial Sequence
  Description of Artificial Sequence: Synthetic oligonucleotide
  Description of Combined DNA/RNA Molecule: Synthetic oligonucleotide
gcgccagaaaguagagggctt

SEQ ID NO: 2035 - DNA, 21 bp, Artificial Sequence
  Description of Artificial Sequence: Synthetic oligonucleotide
  Description of Combined DNA/RNA Molecule: Synthetic oligonucleotide
aguagagggcuccuccagutt

SEQ ID NO: 2036 - DNA, 21 bp, Artificial Sequence
  Description of Artificial Sequence: Synthetic oligonucleotide
  Description of Combined DNA/RNA Molecule: Synthetic oligonucleotide
ccuccagucacuuggugactt

SEQ ID NO: 2037 - DNA, 21 bp, Artificial Sequence
  Description of Artificial Sequence: Synthetic oligonucleotide
  Description of Combined DNA/RNA Molecule: Synthetic oligonucleotide
ucacuuggugacauucacutt

SEQ ID NO: 2038 - DNA, 21 bp, Artificial Sequence
  Description of Artificial Sequence: Synthetic oligonucleotide
  Description of Combined DNA/RNA Molecule: Synthetic oligonucleotide
cauucacugugcuuccucutt

SEQ ID NO: 2039 - DNA, 21 bp, Artificial Sequence
  Description of Artificial Sequence: Synthetic oligonucleotide
  Description of Combined DNA/RNA Molecule: Synthetic oligonucleotide
ggaaauuggccuucacaactt

SEQ ID NO: 2040 - DNA, 21 bp, Artificial Sequence
  Description of Artificial Sequence: Synthetic oligonucleotide
  Description of Combined DNA/RNA Molecule: Synthetic oligonucleotide
cuucacaacaucaauuuuutt

SEQ ID NO: 2041 - DNA, 21 bp, Artificial Sequence
  Description of Artificial Sequence: Synthetic oligonucleotide
  Description of Combined DNA/RNA Molecule: Synthetic oligonucleotide
aauuuuucacuggagacuutt

SEQ ID NO: 2042 - DNA, 21 bp, Artificial Sequence
  Description of Artificial Sequence: Synthetic oligonucleotide
  Description of Combined DNA/RNA Molecule: Synthetic oligonucleotide
cuggagacuugguuuggaatt

SEQ ID NO: 2043 - DNA, 21 bp, Artificial Sequence
  Description of Artificial Sequence: Synthetic oligonucleotide
  Description of Combined DNA/RNA Molecule: Synthetic oligonucleotide
gguuuggaaaagaaaucuutt

SEQ ID NO: 2044 - DNA, 21 bp, Artificial Sequence
  Description of Artificial Sequence: Synthetic oligonucleotide
  Description of Combined DNA/RNA Molecule: Synthetic oligonucleotide
aaucuuaguaaaaacauuatt

SEQ ID NO: 2045 - DNA, 21 bp, Artificial Sequence
  Description of Artificial Sequence: Synthetic oligonucleotide
  Description of Combined DNA/RNA Molecule: Synthetic oligonucleotide
aaaaacauuacgaguggugtt

SEQ ID NO: 2046 - DNA, 21 bp, Artificial Sequence
  Description of Artificial Sequence: Synthetic oligonucleotide
  Description of Combined DNA/RNA Molecule: Synthetic oligonucleotide
gaguggugccagaaggugutt

SEQ ID NO: 2047 - DNA, 21 bp, Artificial Sequence
  Description of Artificial Sequence: Synthetic oligonucleotide
  Description of Combined DNA/RNA Molecule: Synthetic oligonucleotide
agaaggugucaaaagggaatt

SEQ ID NO: 2048 - DNA, 21 bp, Artificial Sequence
  Description of Artificial Sequence: Synthetic oligonucleotide
  Description of Combined DNA/RNA Molecule: Synthetic oligonucleotide
ugucaaaagggaaagcuautt

SEQ ID NO: 2049 - DNA, 21 bp, Artificial Sequence
  Description of Artificial Sequence: Synthetic oligonucleotide
  Description of Combined DNA/RNA Molecule: Synthetic oligonucleotide
gcuauucugguguuacuuutt

SEQ ID NO: 2050 - DNA, 21 bp, Artificial Sequence
  Description of Artificial Sequence: Synthetic oligonucleotide
  Description of Combined DNA/RNA Molecule: Synthetic oligonucleotide
guguuacuuuggauccuagtt

SEQ ID NO: 2051 - DNA, 21 bp, Artificial Sequence
  Description of Artificial Sequence: Synthetic oligonucleotide
  Description of Combined DNA/RNA Molecule: Synthetic oligonucleotide
ggauccuagggguauuuautt

SEQ ID NO: 2052 - DNA, 21 bp, Artificial Sequence
  Description of Artificial Sequence: Synthetic oligonucleotide
  Description of Combined DNA/RNA Molecule: Synthetic oligonucleotide
gguauuuaugguaccauuatt

SEQ ID NO: 2053 - DNA, 21 bp, Artificial Sequence
  Description of Artificial Sequence: Synthetic oligonucleotide
  Description of Combined DNA/RNA Molecule: Synthetic oligonucleotide
guaccauuagcagacgaaatt

SEQ ID NO: 2054 - DNA, 21 bp, Artificial Sequence
  Description of Artificial Sequence: Synthetic oligonucleotide
  Description of Combined DNA/RNA Molecule: Synthetic oligonucleotide
cagacgaaaggaguucccatt

SEQ ID NO: 2055 - DNA, 21 bp, Artificial Sequence
  Description of Artificial Sequence: Synthetic oligonucleotide
  Description of Combined DNA/RNA Molecule: Synthetic oligonucleotide
aggaguucccauacaggautt

SEQ ID NO: 2056 - DNA, 21 bp, Artificial Sequence
  Description of Artificial Sequence: Synthetic oligonucleotide
  Description of Combined DNA/RNA Molecule: Synthetic oligonucleotide
cauacaggauacccuuagatt

SEQ ID NO: 2057 - DNA, 21 bp, Artificial Sequence
  Description of Artificial Sequence: Synthetic oligonucleotide
  Description of Combined DNA/RNA Molecule: Synthetic oligonucleotide
cuuagauuugguccccaaatt

SEQ ID NO: 2058 - DNA, 21 bp, Artificial Sequence
  Description of Artificial Sequence: Synthetic oligonucleotide
  Description of Combined DNA/RNA Molecule: Synthetic oligonucleotide
uccccaaaacagaaaucaatt

SEQ ID NO: 2059 - DNA, 21 bp, Artificial Sequence
  Description of Artificial Sequence: Synthetic oligonucleotide
  Description of Combined DNA/RNA Molecule: Synthetic oligonucleotide
acagaaaucaaaaggauuutt

SEQ ID NO: 2060 - DNA, 21 bp, Artificial Sequence
  Description of Artificial Sequence: Synthetic oligonucleotide
  Description of Combined DNA/RNA Molecule: Synthetic oligonucleotide
aaaggauuuugaguguaaatt

SEQ ID NO: 2061 - DNA, 21 bp, Artificial Sequence
  Description of Artificial Sequence: Synthetic oligonucleotide
  Description of Combined DNA/RNA Molecule: Synthetic oligonucleotide
aguguaaaaggacugcuugtt

SEQ ID NO: 2062 - DNA, 21 bp, Artificial Sequence
  Description of Artificial Sequence: Synthetic oligonucleotide
  Description of Combined DNA/RNA Molecule: Synthetic oligonucleotide
aaggacugcuuguaggugatt

SEQ ID NO: 2063 - DNA, 21 bp, Artificial Sequence
  Description of Artificial Sequence: Synthetic oligonucleotide
  Description of Combined DNA/RNA Molecule: Synthetic oligonucleotide
guaggugagaucuugucugtt

SEQ ID NO: 2064 - DNA, 21 bp, Artificial Sequence
  Description of Artificial Sequence: Synthetic oligonucleotide
  Description of Combined DNA/RNA Molecule: Synthetic oligonucleotide
aucuugucugcaguucuaatt

SEQ ID NO: 2065 - DNA, 21 bp, Artificial Sequence
  Description of Artificial Sequence: Synthetic oligonucleotide
  Description of Combined DNA/RNA Molecule: Synthetic oligonucleotide
guucuaagucaggaaggcatt

SEQ ID NO: 2066 - DNA, 21 bp, Artificial Sequence
  Description of Artificial Sequence: Synthetic oligonucleotide
  Description of Combined DNA/RNA Molecule: Synthetic oligonucleotide
gaaggcaucaauauccuaatt

SEQ ID NO: 2067 - DNA, 21 bp, Artificial Sequence
  Description of Artificial Sequence: Synthetic oligonucleotide
  Description of Combined DNA/RNA Molecule: Synthetic oligonucleotide
ucaauauccuaacccaccutt

SEQ ID NO: 2068 - DNA, 21 bp, Artificial Sequence
  Description of Artificial Sequence: Synthetic oligonucleotide
  Description of Combined DNA/RNA Molecule: Synthetic oligonucleotide
ccaccuccccaaagggagutt

SEQ ID NO: 2069 - DNA, 21 bp, Artificial Sequence
  Description of Artificial Sequence: Synthetic oligonucleotide
  Description of Combined DNA/RNA Molecule: Synthetic oligonucleotide
ccccaaagggagugcagagtt

SEQ ID NO: 2070 - DNA, 21 bp, Artificial Sequence
  Description of Artificial Sequence: Synthetic oligonucleotide
  Description of Combined DNA/RNA Molecule: Synthetic oligonucleotide
gugcagaggcggagcugautt

SEQ ID NO: 2071 - DNA, 21 bp, Artificial Sequence
  Description of Artificial Sequence: Synthetic oligonucleotide
  Description of Combined DNA/RNA Molecule: Synthetic oligonucleotide
ggagcugaugagcguuguctt

SEQ ID NO: 2072 - DNA, 21 bp, Artificial Sequence
  Description of Artificial Sequence: Synthetic oligonucleotide
  Description of Combined DNA/RNA Molecule: Synthetic oligonucleotide
cguugucccaguauucuautt

SEQ ID NO: 2073 - DNA, 21 bp, Artificial Sequence
  Description of Artificial Sequence: Synthetic oligonucleotide
  Description of Combined DNA/RNA Molecule: Synthetic oligonucleotide
ccaguauucuauguuuuuctt

SEQ ID NO: 2074 - DNA, 21 bp, Artificial Sequence
  Description of Artificial Sequence: Synthetic oligonucleotide
  Description of Combined DNA/RNA Molecule: Synthetic oligonucleotide
guuuuucacuaccuggaaatt

SEQ ID NO: 2075 - DNA, 21 bp, Artificial Sequence
  Description of Artificial Sequence: Synthetic oligonucleotide
  Description of Combined DNA/RNA Molecule: Synthetic oligonucleotide
ccuggaaacaggaaaucautt

SEQ ID NO: 2076 - DNA, 21 bp, Artificial Sequence
  Description of Artificial Sequence: Synthetic oligonucleotide
  Description of Combined DNA/RNA Molecule: Synthetic oligonucleotide
ggaacauuuuucauucugatt

SEQ ID NO: 2077 - DNA, 21 bp, Artificial Sequence
  Description of Artificial Sequence: Synthetic oligonucleotide
  Description of Combined DNA/RNA Molecule: Synthetic oligonucleotide
cauucugacccauuaauugtt

SEQ ID NO: 2078 - DNA, 21 bp, Artificial Sequence
  Description of Artificial Sequence: Synthetic oligonucleotide
  Description of Combined DNA/RNA Molecule: Synthetic oligonucleotide
ccauuaauugaaaagcagatt

SEQ ID NO: 2079 - DNA, 21 bp, Artificial Sequence
  Description of Artificial Sequence: Synthetic oligonucleotide
  Description of Combined DNA/RNA Molecule: Synthetic oligonucleotide
aaagcagaaacugaagaaatt

SEQ ID NO: 2080 - DNA, 21 bp, Artificial Sequence
  Description of Artificial Sequence: Synthetic oligonucleotide
  Description of Combined DNA/RNA Molecule: Synthetic oligonucleotide
aacugaagaaaaaauuaaatt

SEQ ID NO: 2081 - DNA, 21 bp, Artificial Sequence
  Description of Artificial Sequence: Synthetic oligonucleotide
  Description of Combined DNA/RNA Molecule: Synthetic oligonucleotide
aaaaaauuaaaagaagggatt

SEQ ID NO: 2082 - DNA, 21 bp, Artificial Sequence
  Description of Artificial Sequence: Synthetic oligonucleotide
  Description of Combined DNA/RNA Molecule: Synthetic oligonucleotide
agggauguugagcauuaugtt

SEQ ID NO: 2083 - DNA, 21 bp, Artificial Sequence
  Description of Artificial Sequence: Synthetic oligonucleotide
  Description of Combined DNA/RNA Molecule: Synthetic oligonucleotide
gagcauuauguccuacagatt

SEQ ID NO: 2084 - DNA, 21 bp, Artificial Sequence
  Description of Artificial Sequence: Synthetic oligonucleotide
  Description of Combined DNA/RNA Molecule: Synthetic oligonucleotide
uguccuacagaaaugcugatt

SEQ ID NO: 2085 - DNA, 21 bp, Artificial Sequence
  Description of Artificial Sequence: Synthetic oligonucleotide
  Description of Combined DNA/RNA Molecule: Synthetic oligonucleotide
aaugcugacuacucuuacatt

SEQ ID NO: 2086 - DNA, 21 bp, Artificial Sequence
  Description of Artificial Sequence: Synthetic oligonucleotide
  Description of Combined DNA/RNA Molecule: Synthetic oligonucleotide
uacucuuacaguguguggatt

SEQ ID NO: 2087 - DNA, 21 bp, Artificial Sequence
  Description of Artificial Sequence: Synthetic oligonucleotide
  Description of Combined DNA/RNA Molecule: Synthetic oligonucleotide
aguguguggaaggguggaatt

SEQ ID NO: 2088 - DNA, 21 bp, Artificial Sequence
  Description of Artificial Sequence: Synthetic oligonucleotide
  Description of Combined DNA/RNA Molecule: Synthetic oligonucleotide
ggguggaagugcuagcacutt

SEQ ID NO: 2089 - DNA, 21 bp, Artificial Sequence
  Description of Artificial Sequence: Synthetic oligonucleotide
  Description of Combined DNA/RNA Molecule: Synthetic oligonucleotide
gcuagcacuugguuaacagtt

SEQ ID NO: 2090 - DNA, 21 bp, Artificial Sequence
  Description of Artificial Sequence: Synthetic oligonucleotide
  Description of Combined DNA/RNA Molecule: Synthetic oligonucleotide
gguuaacagcuuuugcuuutt

SEQ ID NO: 2091 - DNA, 21 bp, Artificial Sequence
  Description of Artificial Sequence: Synthetic oligonucleotide
  Description of Combined DNA/RNA Molecule: Synthetic oligonucleotide
ugcuuuaagaguacuuggatt

SEQ ID NO: 2092 - DNA, 21 bp, Artificial Sequence
  Description of Artificial Sequence: Synthetic oligonucleotide
  Description of Combined DNA/RNA Molecule: Synthetic oligonucleotide
guacuuggacaaguaaauatt

SEQ ID NO: 2093 - DNA, 21 bp, Artificial Sequence
  Description of Artificial Sequence: Synthetic oligonucleotide
  Description of Combined DNA/RNA Molecule: Synthetic oligonucleotide
caaguaaauaaauacguagtt

SEQ ID NO: 2094 - DNA, 21 bp, Artificial Sequence
  Description of Artificial Sequence: Synthetic oligonucleotide
  Description of Combined DNA/RNA Molecule: Synthetic oligonucleotide
auaaauacguagagcagaatt

SEQ ID NO: 2095 - DNA, 21 bp, Artificial Sequence
  Description of Artificial Sequence: Synthetic oligonucleotide
  Description of Combined DNA/RNA Molecule: Synthetic oligonucleotide
gagcagaaccaaaauucaatt

SEQ ID NO: 2096 - DNA, 21 bp, Artificial Sequence
  Description of Artificial Sequence: Synthetic oligonucleotide
  Description of Combined DNA/RNA Molecule: Synthetic oligonucleotide
aauucaauuuguaauucuutt

SEQ ID NO: 2097 - DNA, 21 bp, Artificial Sequence
  Description of Artificial Sequence: Synthetic oligonucleotide
  Description of Combined DNA/RNA Molecule: Synthetic oligonucleotide
guaauucuuuauuguggcutt

SEQ ID NO: 2098 - DNA, 21 bp, Artificial Sequence
  Description of Artificial Sequence: Synthetic oligonucleotide
  Description of Combined DNA/RNA Molecule: Synthetic oligonucleotide
auuguggcuaguugagaautt

SEQ ID NO: 2099 - DNA, 21 bp, Artificial Sequence
  Description of Artificial Sequence: Synthetic oligonucleotide
  Description of Combined DNA/RNA Molecule: Synthetic oligonucleotide
cuaguugagaauuaucaautt

SEQ ID NO: 2100 - DNA, 21 bp, Artificial Sequence
  Description of Artificial Sequence: Synthetic oligonucleotide
  Description of Combined DNA/RNA Molecule: Synthetic oligonucleotide
uuaucaauuagauaauggatt

SEQ ID NO: 2101 - DNA, 21 bp, Artificial Sequence
  Description of Artificial Sequence: Synthetic oligonucleotide
  Description of Combined DNA/RNA Molecule: Synthetic oligonucleotide
aauggaucuuucaaggaaatt

SEQ ID NO: 2102 - DNA, 21 bp, Artificial Sequence
  Description of Artificial Sequence: Synthetic oligonucleotide
  Description of Combined DNA/RNA Molecule: Synthetic oligonucleotide
cuuucaaggaaaauucacatt

SEQ ID NO: 2103 - DNA, 21 bp, Artificial Sequence
  Description of Artificial Sequence: Synthetic oligonucleotide
  Description of Combined DNA/RNA Molecule: Synthetic oligonucleotide
aauucacaguaucaaccaatt

SEQ ID NO: 2104 - DNA, 21 bp, Artificial Sequence
  Description of Artificial Sequence: Synthetic oligonucleotide
  Description of Combined DNA/RNA Molecule: Synthetic oligonucleotide
guaucaaccaauaaaauuatt

SEQ ID NO: 2105 - DNA, 21 bp, Artificial Sequence
  Description of Artificial Sequence: Synthetic oligonucleotide
  Description of Combined DNA/RNA Molecule: Synthetic oligonucleotide
aaaauuacaggguaccuugtt

SEQ ID NO: 2106 - DNA, 21 bp, Artificial Sequence
  Description of Artificial Sequence: Synthetic oligonucleotide
  Description of Combined DNA/RNA Molecule: Synthetic oligonucleotide
aggguaccuugccuguugatt

SEQ ID NO: 2107 - DNA, 21 bp, Artificial Sequence
  Description of Artificial Sequence: Synthetic oligonucleotide
  Description of Combined DNA/RNA Molecule: Synthetic oligonucleotide
guugaagcccgagagaacatt

SEQ ID NO: 2108 - DNA, 21 bp, Artificial Sequence
  Description of Artificial Sequence: Synthetic oligonucleotide
  Description of Combined DNA/RNA Molecule: Synthetic oligonucleotide
ccgagagaacagcuuauautt

SEQ ID NO: 2109 - DNA, 21 bp, Artificial Sequence
  Description of Artificial Sequence: Synthetic oligonucleotide
  Description of Combined DNA/RNA Molecule: Synthetic oligonucleotide
gcuuauaucuuacagccuutt

SEQ ID NO: 2110 - DNA, 21 bp, Artificial Sequence
  Description of Artificial Sequence: Synthetic oligonucleotide
  Description of Combined DNA/RNA Molecule: Synthetic oligonucleotide
cuuacagccuuuacugugatt

SEQ ID NO: 2111 - DNA, 21 bp, Artificial Sequence
  Description of Artificial Sequence: Synthetic oligonucleotide
  Description of Combined DNA/RNA Molecule: Synthetic oligonucleotide
gaauuagaaaggcuuucgatt

SEQ ID NO: 2112 - DNA, 21 bp, Artificial Sequence
  Description of Artificial Sequence: Synthetic oligonucleotide
  Description of Combined DNA/RNA Molecule: Synthetic oligonucleotide
ggcuuucgauauaugcccctt

SEQ ID NO: 2113 - DNA, 21 bp, Artificial Sequence
  Description of Artificial Sequence: Synthetic oligonucleotide
  Description of Combined DNA/RNA Molecule: Synthetic oligonucleotide
gauauaugcccccuggugatt

SEQ ID NO: 2114 - DNA, 21 bp, Artificial Sequence
  Description of Artificial Sequence: Synthetic oligonucleotide
  Description of Combined DNA/RNA Molecule: Synthetic oligonucleotide
ggugaaaaucgacacagcutt

SEQ ID NO: 2115 - DNA, 21 bp, Artificial Sequence
  Description of Artificial Sequence: Synthetic oligonucleotide
  Description of Combined DNA/RNA Molecule: Synthetic oligonucleotide
cgacacagcucuaauuaaatt

SEQ ID NO: 2116 - DNA, 21 bp, Artificial Sequence
  Description of Artificial Sequence: Synthetic oligonucleotide
  Description of Combined DNA/RNA Molecule: Synthetic oligonucleotide
gcucuaauuaaagcugacatt

SEQ ID NO: 2117 - DNA, 21 bp, Artificial Sequence
  Description of Artificial Sequence: Synthetic oligonucleotide
  Description of Combined DNA/RNA Molecule: Synthetic oligonucleotide
cugacaacuuucugcuugatt

SEQ ID NO: 2118 - DNA, 21 bp, Artificial Sequence
  Description of Artificial Sequence: Synthetic oligonucleotide
  Description of Combined DNA/RNA Molecule: Synthetic oligonucleotide
cuuucugcuugaaaauacatt

SEQ ID NO: 2119 - DNA, 21 bp, Artificial Sequence
  Description of Artificial Sequence: Synthetic oligonucleotide
  Description of Combined DNA/RNA Molecule: Synthetic oligonucleotide
aaaauacacugccagcccatt

SEQ ID NO: 2120 - DNA, 21 bp, Artificial Sequence
  Description of Artificial Sequence: Synthetic oligonucleotide
  Description of Combined DNA/RNA Molecule: Synthetic oligonucleotide
agcccagagcaccuuuacatt

SEQ ID NO: 2121 - DNA, 21 bp, Artificial Sequence
  Description of Artificial Sequence: Synthetic oligonucleotide
  Description of Combined DNA/RNA Molecule: Synthetic oligonucleotide
gcaccuuuacauuggccautt

SEQ ID NO: 2122 - DNA, 21 bp, Artificial Sequence
  Description of Artificial Sequence: Synthetic oligonucleotide
  Description of Combined DNA/RNA Molecule: Synthetic oligonucleotide
acauuggccauuucugcgutt

SEQ ID NO: 2123 - DNA, 21 bp, Artificial Sequence
  Description of Artificial Sequence: Synthetic oligonucleotide
  Description of Combined DNA/RNA Molecule: Synthetic oligonucleotide
cugcguaugcucuuucccutt

SEQ ID NO: 2124 - DNA, 21 bp, Artificial Sequence
  Description of Artificial Sequence: Synthetic oligonucleotide
  Description of Combined DNA/RNA Molecule: Synthetic oligonucleotide
cuuucccugggagauaaaatt

SEQ ID NO: 2125 - DNA, 21 bp, Artificial Sequence
  Description of Artificial Sequence: Synthetic oligonucleotide
  Description of Combined DNA/RNA Molecule: Synthetic oligonucleotide
gagauaaaacucacccacatt

SEQ ID NO: 2126 - DNA, 21 bp, Artificial Sequence
  Description of Artificial Sequence: Synthetic oligonucleotide
  Description of Combined DNA/RNA Molecule: Synthetic oligonucleotide
acucacccacaguuucguutt

SEQ ID NO: 2127 - DNA, 21 bp, Artificial Sequence
  Description of Artificial Sequence: Synthetic oligonucleotide
  Description of Combined DNA/RNA Molecule: Synthetic oligonucleotide
caguuucguucaauuguuutt

SEQ ID NO: 2128 - DNA, 21 bp, Artificial Sequence
  Description of Artificial Sequence: Synthetic oligonucleotide
  Description of Combined DNA/RNA Molecule: Synthetic oligonucleotide
caauuguuucagcuuugaatt

SEQ ID NO: 2129 - DNA, 21 bp, Artificial Sequence
  Description of Artificial Sequence: Synthetic oligonucleotide
  Description of Combined DNA/RNA Molecule: Synthetic oligonucleotide
cuuugaagagagaagcuuutt

SEQ ID NO: 2130 - DNA, 21 bp, Artificial Sequence
  Description of Artificial Sequence: Synthetic oligonucleotide
  Description of Combined DNA/RNA Molecule: Synthetic oligonucleotide
gagagaagcuuugguuaaatt

SEQ ID NO: 2131 - DNA, 21 bp, Artificial Sequence
  Description of Artificial Sequence: Synthetic oligonucleotide
  Description of Combined DNA/RNA Molecule: Synthetic oligonucleotide
guuaaagguaauccacccatt

SEQ ID NO: 2132 - DNA, 21 bp, Artificial Sequence
  Description of Artificial Sequence: Synthetic oligonucleotide
  Description of Combined DNA/RNA Molecule: Synthetic oligonucleotide
aauccacccauuuaucguutt

SEQ ID NO: 2133 - DNA, 21 bp, Artificial Sequence
  Description of Artificial Sequence: Synthetic oligonucleotide
  Description of Combined DNA/RNA Molecule: Synthetic oligonucleotide
cauuuaucguuuuuggaaatt

SEQ ID NO: 2134 - DNA, 21 bp, Artificial Sequence
  Description of Artificial Sequence: Synthetic oligonucleotide
  Description of Combined DNA/RNA Molecule: Synthetic oligonucleotide
uuuggaaagacaaucuucatt

SEQ ID NO: 2135 - DNA, 21 bp, Artificial Sequence
  Description of Artificial Sequence: Synthetic oligonucleotide
  Description of Combined DNA/RNA Molecule: Synthetic oligonucleotide
aaucuucagcauaaagacatt

SEQ ID NO: 2136 - DNA, 21 bp, Artificial Sequence
  Description of Artificial Sequence: Synthetic oligonucleotide
  Description of Combined DNA/RNA Molecule: Synthetic oligonucleotide
cucuguaccuaacacuggutt

SEQ ID NO: 2137 - DNA, 21 bp, Artificial Sequence
  Description of Artificial Sequence: Synthetic oligonucleotide
  Description of Combined DNA/RNA Molecule: Synthetic oligonucleotide
acacugguacggcacguautt

SEQ ID NO: 2138 - DNA, 21 bp, Artificial Sequence
  Description of Artificial Sequence: Synthetic oligonucleotide
  Description of Combined DNA/RNA Molecule: Synthetic oligonucleotide
ggcacguaugguagaaacatt

SEQ ID NO: 2139 - DNA, 21 bp, Artificial Sequence
  Description of Artificial Sequence: Synthetic oligonucleotide
  Description of Combined DNA/RNA Molecule: Synthetic oligonucleotide
gguagaaacaacugccuautt

SEQ ID NO: 2140 - DNA, 21 bp, Artificial Sequence
  Description of Artificial Sequence: Synthetic oligonucleotide
  Description of Combined DNA/RNA Molecule: Synthetic oligonucleotide
caacugccuaugcuuuacutt

SEQ ID NO: 2141 - DNA, 21 bp, Artificial Sequence
  Description of Artificial Sequence: Synthetic oligonucleotide
  Description of Combined DNA/RNA Molecule: Synthetic oligonucleotide
cuuuacucaccagucugaatt

SEQ ID NO: 2142 - DNA, 21 bp, Artificial Sequence
  Description of Artificial Sequence: Synthetic oligonucleotide
  Description of Combined DNA/RNA Molecule: Synthetic oligonucleotide
gucugaacuugaaagauautt

SEQ ID NO: 2143 - DNA, 21 bp, Artificial Sequence
  Description of Artificial Sequence: Synthetic oligonucleotide
  Description of Combined DNA/RNA Molecule: Synthetic oligonucleotide
acuugaaagauauaaauuatt

SEQ ID NO: 2144 - DNA, 21 bp, Artificial Sequence
  Description of Artificial Sequence: Synthetic oligonucleotide
  Description of Combined DNA/RNA Molecule: Synthetic oligonucleotide
uauaaauuauguuaacccatt

SEQ ID NO: 2145 - DNA, 21 bp, Artificial Sequence
  Description of Artificial Sequence: Synthetic oligonucleotide
  Description of Combined DNA/RNA Molecule: Synthetic oligonucleotide
guuaacccagucaucaaautt

SEQ ID NO: 2146 - DNA, 21 bp, Artificial Sequence
  Description of Artificial Sequence: Synthetic oligonucleotide
  Description of Combined DNA/RNA Molecule: Synthetic oligonucleotide
ucaucaaauggcuaucagatt

SEQ ID NO: 2147 - DNA, 21 bp, Artificial Sequence
  Description of Artificial Sequence: Synthetic oligonucleotide
  Description of Combined DNA/RNA Molecule: Synthetic oligonucleotide
uaucagaagagcagagguatt

SEQ ID NO: 2148 - DNA, 21 bp, Artificial Sequence
  Description of Artificial Sequence: Synthetic oligonucleotide
  Description of Combined DNA/RNA Molecule: Synthetic oligonucleotide
agagguauggagguggcuutt

SEQ ID NO: 2149 - DNA, 21 bp, Artificial Sequence
  Description of Artificial Sequence: Synthetic oligonucleotide
  Description of Combined DNA/RNA Molecule: Synthetic oligonucleotide
gagguggcuuuuauucaactt

SEQ ID NO: 2150 - DNA, 21 bp, Artificial Sequence
  Description of Artificial Sequence: Synthetic oligonucleotide
  Description of Combined DNA/RNA Molecule: Synthetic oligonucleotide
uauucaacccaggacacaatt

SEQ ID NO: 2151 - DNA, 21 bp, Artificial Sequence
  Description of Artificial Sequence: Synthetic oligonucleotide
  Description of Combined DNA/RNA Molecule: Synthetic oligonucleotide
aggacacaaucaaugccautt

SEQ ID NO: 2152 - DNA, 21 bp, Artificial Sequence
  Description of Artificial Sequence: Synthetic oligonucleotide
  Description of Combined DNA/RNA Molecule: Synthetic oligonucleotide
caaucaaugccauugagggtt

SEQ ID NO: 2153 - DNA, 21 bp, Artificial Sequence
  Description of Artificial Sequence: Synthetic oligonucleotide
  Description of Combined DNA/RNA Molecule: Synthetic oligonucleotide
cauugagggccugacggaatt

SEQ ID NO: 2154 - DNA, 21 bp, Artificial Sequence
  Description of Artificial Sequence: Synthetic oligonucleotide
  Description of Combined DNA/RNA Molecule: Synthetic oligonucleotide
acggaauauucacuccuggtt

SEQ ID NO: 2155 - DNA, 21 bp, Artificial Sequence
  Description of Artificial Sequence: Synthetic oligonucleotide
  Description of Combined DNA/RNA Molecule: Synthetic oligonucleotide
uucacuccugguuaaacaatt

SEQ ID NO: 2156 - DNA, 21 bp, Artificial Sequence
  Description of Artificial Sequence: Synthetic oligonucleotide
  Description of Combined DNA/RNA Molecule: Synthetic oligonucleotide
gguuaaacaacuccgcuugtt

SEQ ID NO: 2157 - DNA, 21 bp, Artificial Sequence
  Description of Artificial Sequence: Synthetic oligonucleotide
  Description of Combined DNA/RNA Molecule: Synthetic oligonucleotide
ccgcuugaguauggacauctt

SEQ ID NO: 2158 - DNA, 21 bp, Artificial Sequence
  Description of Artificial Sequence: Synthetic oligonucleotide
  Description of Combined DNA/RNA Molecule: Synthetic oligonucleotide
ggacaucgauguuucuuactt

SEQ ID NO: 2159 - DNA, 21 bp, Artificial Sequence
  Description of Artificial Sequence: Synthetic oligonucleotide
  Description of Combined DNA/RNA Molecule: Synthetic oligonucleotide
cgauguuucuuacaagcautt

SEQ ID NO: 2160 - DNA, 21 bp, Artificial Sequence
  Description of Artificial Sequence: Synthetic oligonucleotide
  Description of Combined DNA/RNA Molecule: Synthetic oligonucleotide
caagcauaaaggugccuuatt

SEQ ID NO: 2161 - DNA, 21 bp, Artificial Sequence
  Description of Artificial Sequence: Synthetic oligonucleotide
  Description of Combined DNA/RNA Molecule: Synthetic oligonucleotide
gugccuuacauaauuauaatt

SEQ ID NO: 2162 - DNA, 21 bp, Artificial Sequence
  Description of Artificial Sequence: Synthetic oligonucleotide
  Description of Combined DNA/RNA Molecule: Synthetic oligonucleotide
acauaauuauaaaaugacatt

SEQ ID NO: 2163 - DNA, 21 bp, Artificial Sequence
  Description of Artificial Sequence: Synthetic oligonucleotide
  Description of Combined DNA/RNA Molecule: Synthetic oligonucleotide
aaaaugacagacaagaauutt

SEQ ID NO: 2164 - DNA, 21 bp, Artificial Sequence
  Description of Artificial Sequence: Synthetic oligonucleotide
  Description of Combined DNA/RNA Molecule: Synthetic oligonucleotide
caagaauuuccuugggaggtt

SEQ ID NO: 2165 - DNA, 21 bp, Artificial Sequence
  Description of Artificial Sequence: Synthetic oligonucleotide
  Description of Combined DNA/RNA Molecule: Synthetic oligonucleotide
ccuugggaggccaguagagtt

SEQ ID NO: 2166 - DNA, 21 bp, Artificial Sequence
  Description of Artificial Sequence: Synthetic oligonucleotide
  Description of Combined DNA/RNA Molecule: Synthetic oligonucleotide
aguagaggugcuucucaautt

SEQ ID NO: 2167 - DNA, 21 bp, Artificial Sequence
  Description of Artificial Sequence: Synthetic oligonucleotide
  Description of Combined DNA/RNA Molecule: Synthetic oligonucleotide
cuucucaaugaugaccucatt

SEQ ID NO: 2168 - DNA, 21 bp, Artificial Sequence
  Description of Artificial Sequence: Synthetic oligonucleotide
  Description of Combined DNA/RNA Molecule: Synthetic oligonucleotide
ugaccucauugucaguacatt

SEQ ID NO: 2169 - DNA, 21 bp, Artificial Sequence
  Description of Artificial Sequence: Synthetic oligonucleotide
  Description of Combined DNA/RNA Molecule: Synthetic oligonucleotide
gucaguacaggauuuggcatt

SEQ ID NO: 2170 - DNA, 21 bp, Artificial Sequence
  Description of Artificial Sequence: Synthetic oligonucleotide
  Description of Combined DNA/RNA Molecule: Synthetic oligonucleotide
aggauuuggcaguggcuugtt

SEQ ID NO: 2171 - DNA, 21 bp, Artificial Sequence
  Description of Artificial Sequence: Synthetic oligonucleotide
  Description of Combined DNA/RNA Molecule: Synthetic oligonucleotide
uggcuuggcuacaguacautt

SEQ ID NO: 2172 - DNA, 21 bp, Artificial Sequence
  Description of Artificial Sequence: Synthetic oligonucleotide
  Description of Combined DNA/RNA Molecule: Synthetic oligonucleotide
gcuacaguacauguaacaatt

SEQ ID NO: 2173 - DNA, 21 bp, Artificial Sequence
  Description of Artificial Sequence: Synthetic oligonucleotide
  Description of Combined DNA/RNA Molecule: Synthetic oligonucleotide
aacaacuguaguucacaaatt

SEQ ID NO: 2174 - DNA, 21 bp, Artificial Sequence
  Description of Artificial Sequence: Synthetic oligonucleotide
  Description of Combined DNA/RNA Molecule: Synthetic oligonucleotide
guaguucacaaaaccaguatt

SEQ ID NO: 2175 - DNA, 21 bp, Artificial Sequence
  Description of Artificial Sequence: Synthetic oligonucleotide
  Description of Combined DNA/RNA Molecule: Synthetic oligonucleotide
aaaccaguaccucugaggatt

SEQ ID NO: 2176 - DNA, 21 bp, Artificial Sequence
  Description of Artificial Sequence: Synthetic oligonucleotide
  Description of Combined DNA/RNA Molecule: Synthetic oligonucleotide
ugaggaaguuugcagcuuutt

SEQ ID NO: 2177 - DNA, 21 bp, Artificial Sequence
  Description of Artificial Sequence: Synthetic oligonucleotide
  Description of Combined DNA/RNA Molecule: Synthetic oligonucleotide
ugcagcuuuuauuugaaaatt

SEQ ID NO: 2178 - DNA, 21 bp, Artificial Sequence
  Description of Artificial Sequence: Synthetic oligonucleotide
  Description of Combined DNA/RNA Molecule: Synthetic oligonucleotide
auuugaaaaucgauacucatt

SEQ ID NO: 2179 - DNA, 21 bp, Artificial Sequence
  Description of Artificial Sequence: Synthetic oligonucleotide
  Description of Combined DNA/RNA Molecule: Synthetic oligonucleotide
cgauacucaggauauugaatt

SEQ ID NO: 2180 - DNA, 21 bp, Artificial Sequence
  Description of Artificial Sequence: Synthetic oligonucleotide
  Description of Combined DNA/RNA Molecule: Synthetic oligonucleotide
ggauauugaagcaucccactt

SEQ ID NO: 2181 - DNA, 21 bp, Artificial Sequence
  Description of Artificial Sequence: Synthetic oligonucleotide
  Description of Combined DNA/RNA Molecule: Synthetic oligonucleotide
gaagcaucccacuacagagtt

SEQ ID NO: 2182 - DNA, 21 bp, Artificial Sequence
  Description of Artificial Sequence: Synthetic oligonucleotide
  Description of Combined DNA/RNA Molecule: Synthetic oligonucleotide
acuacagaggcuacggaaatt

SEQ ID NO: 2183 - DNA, 21 bp, Artificial Sequence
  Description of Artificial Sequence: Synthetic oligonucleotide
  Description of Combined DNA/RNA Molecule: Synthetic oligonucleotide
cggaaacucugauuacaaatt

SEQ ID NO: 2184 - DNA, 21 bp, Artificial Sequence
  Description of Artificial Sequence: Synthetic oligonucleotide
  Description of Combined DNA/RNA Molecule: Synthetic oligonucleotide
ugauuacaaacgcauaguatt

SEQ ID NO: 2185 - DNA, 21 bp, Artificial Sequence
  Description of Artificial Sequence: Synthetic oligonucleotide
  Description of Combined DNA/RNA Molecule: Synthetic oligonucleotide
gcauaguagcaugugccagtt

SEQ ID NO: 2186 - DNA, 21 bp, Artificial Sequence
  Description of Artificial Sequence: Synthetic oligonucleotide
  Description of Combined DNA/RNA Molecule: Synthetic oligonucleotide
gcaugugccagcuacaagctt

SEQ ID NO: 2187 - DNA, 21 bp, Artificial Sequence
  Description of Artificial Sequence: Synthetic oligonucleotide
  Description of Combined DNA/RNA Molecule: Synthetic oligonucleotide
cuacaagcccagcagggaatt

SEQ ID NO: 2188 - DNA, 21 bp, Artificial Sequence
  Description of Artificial Sequence: Synthetic oligonucleotide
  Description of Combined DNA/RNA Molecule: Synthetic oligonucleotide
cagcagggaagaaucaucatt

SEQ ID NO: 2189 - DNA, 21 bp, Artificial Sequence
  Description of Artificial Sequence: Synthetic oligonucleotide
  Description of Combined DNA/RNA Molecule: Synthetic oligonucleotide
gaaucaucaucuggauccutt

SEQ ID NO: 2190 - DNA, 21 bp, Artificial Sequence
  Description of Artificial Sequence: Synthetic oligonucleotide
  Description of Combined DNA/RNA Molecule: Synthetic oligonucleotide
gauccucucaugcggugautt

SEQ ID NO: 2191 - DNA, 21 bp, Artificial Sequence
  Description of Artificial Sequence: Synthetic oligonucleotide
  Description of Combined DNA/RNA Molecule: Synthetic oligonucleotide
cucaugcggugauggacautt

SEQ ID NO: 2192 - DNA, 21 bp, Artificial Sequence
  Description of Artificial Sequence: Synthetic oligonucleotide
  Description of Combined DNA/RNA Molecule: Synthetic oligonucleotide
gauggacaucuccuugccutt

SEQ ID NO: 2193 - DNA, 21 bp, Artificial Sequence
  Description of Artificial Sequence: Synthetic oligonucleotide
  Description of Combined DNA/RNA Molecule: Synthetic oligonucleotide
cuugccuacuggaaucagutt

SEQ ID NO: 2194 - DNA, 21 bp, Artificial Sequence
  Description of Artificial Sequence: Synthetic oligonucleotide
  Description of Combined DNA/RNA Molecule: Synthetic oligonucleotide
gaaucagugcaaaugaagatt

SEQ ID NO: 2195 - DNA, 21 bp, Artificial Sequence
  Description of Artificial Sequence: Synthetic oligonucleotide
  Description of Combined DNA/RNA Molecule: Synthetic oligonucleotide
aaaugaagaagacuuaaaatt

SEQ ID NO: 2196 - DNA, 21 bp, Artificial Sequence
  Description of Artificial Sequence: Synthetic oligonucleotide
  Description of Combined DNA/RNA Molecule: Synthetic oligonucleotide
gaagacuuaaaagcccuugtt

SEQ ID NO: 2197 - DNA, 21 bp, Artificial Sequence
  Description of Artificial Sequence: Synthetic oligonucleotide
  Description of Combined DNA/RNA Molecule: Synthetic oligonucleotide
ccuuguggaagggguggautt

SEQ ID NO: 2198 - DNA, 21 bp, Artificial Sequence
  Description of Artificial Sequence: Synthetic oligonucleotide
  Description of Combined DNA/RNA Molecule: Synthetic oligonucleotide
gaagggguggaucaacuautt

SEQ ID NO: 2199 - DNA, 21 bp, Artificial Sequence
  Description of Artificial Sequence: Synthetic oligonucleotide
  Description of Combined DNA/RNA Molecule: Synthetic oligonucleotide
aucaacuauucacugauuatt

SEQ ID NO: 2200 - DNA, 21 bp, Artificial Sequence
  Description of Artificial Sequence: Synthetic oligonucleotide
  Description of Combined DNA/RNA Molecule: Synthetic oligonucleotide
cacugauuaccaaaucaaatt

SEQ ID NO: 2201 - DNA, 21 bp, Artificial Sequence
  Description of Artificial Sequence: Synthetic oligonucleotide
  Description of Combined DNA/RNA Molecule: Synthetic oligonucleotide
aucaaagauggacauguuatt

SEQ ID NO: 2202 - DNA, 21 bp, Artificial Sequence
  Description of Artificial Sequence: Synthetic oligonucleotide
  Description of Combined DNA/RNA Molecule: Synthetic oligonucleotide
ggacauguuauucugcaactt

SEQ ID NO: 2203 - DNA, 21 bp, Artificial Sequence
  Description of Artificial Sequence: Synthetic oligonucleotide
  Description of Combined DNA/RNA Molecule: Synthetic oligonucleotide
ucugcaacugaauucgauutt

SEQ ID NO: 2204 - DNA, 21 bp, Artificial Sequence
  Description of Artificial Sequence: Synthetic oligonucleotide
  Description of Combined DNA/RNA Molecule: Synthetic oligonucleotide
gaauucgauucccuccagutt

SEQ ID NO: 2205 - DNA, 21 bp, Artificial Sequence
  Description of Artificial Sequence: Synthetic oligonucleotide
  Description of Combined DNA/RNA Molecule: Synthetic oligonucleotide
cccuccagugauuuccuuutt

SEQ ID NO: 2206 - DNA, 21 bp, Artificial Sequence
  Description of Artificial Sequence: Synthetic oligonucleotide
  Description of Combined DNA/RNA Molecule: Synthetic oligonucleotide
gauuuccuuuguguacgautt

SEQ ID NO: 2207 - DNA, 21 bp, Artificial Sequence
  Description of Artificial Sequence: Synthetic oligonucleotide
  Description of Combined DNA/RNA Molecule: Synthetic oligonucleotide
guacgauuccggauauuugtt

SEQ ID NO: 2208 - DNA, 21 bp, Artificial Sequence
  Description of Artificial Sequence: Synthetic oligonucleotide
  Description of Combined DNA/RNA Molecule: Synthetic oligonucleotide
cggauauuugaacucuuugtt

SEQ ID NO: 2209 - DNA, 21 bp, Artificial Sequence
  Description of Artificial Sequence: Synthetic oligonucleotide
  Description of Combined DNA/RNA Molecule: Synthetic oligonucleotide
acucuuugaaguuggguuutt

SEQ ID NO: 2210 - DNA, 21 bp, Artificial Sequence
  Description of Artificial Sequence: Synthetic oligonucleotide
  Description of Combined DNA/RNA Molecule: Synthetic oligonucleotide
aguuggguuucucaguccutt

SEQ ID NO: 2211 - DNA, 21 bp, Artificial Sequence
  Description of Artificial Sequence: Synthetic oligonucleotide
  Description of Combined DNA/RNA Molecule: Synthetic oligonucleotide
uucucaguccugccacuuutt

SEQ ID NO: 2212 - DNA, 21 bp, Artificial Sequence
  Description of Artificial Sequence: Synthetic oligonucleotide
  Description of Combined DNA/RNA Molecule: Synthetic oligonucleotide
cacuuucacaguguacgaatt

SEQ ID NO: 2213 - DNA, 21 bp, Artificial Sequence
  Description of Artificial Sequence: Synthetic oligonucleotide
  Description of Combined DNA/RNA Molecule: Synthetic oligonucleotide
cacaguguacgaauaccactt

SEQ ID NO: 2214 - DNA, 21 bp, Artificial Sequence
  Description of Artificial Sequence: Synthetic oligonucleotide
  Description of Combined DNA/RNA Molecule: Synthetic oligonucleotide
accacagaccagauaaacatt

SEQ ID NO: 2215 - DNA, 21 bp, Artificial Sequence
  Description of Artificial Sequence: Synthetic oligonucleotide
  Description of Combined DNA/RNA Molecule: Synthetic oligonucleotide
ccagauaaacaguguaccatt

SEQ ID NO: 2216 - DNA, 21 bp, Artificial Sequence
  Description of Artificial Sequence: Synthetic oligonucleotide
  Description of Combined DNA/RNA Molecule: Synthetic oligonucleotide
caguguaccauguuuuauatt

SEQ ID NO: 2217 - DNA, 21 bp, Artificial Sequence
  Description of Artificial Sequence: Synthetic oligonucleotide
  Description of Combined DNA/RNA Molecule: Synthetic oligonucleotide
guuuuauagcacuuccaautt

SEQ ID NO: 2218 - DNA, 21 bp, Artificial Sequence
  Description of Artificial Sequence: Synthetic oligonucleotide
  Description of Combined DNA/RNA Molecule: Synthetic oligonucleotide
cuuccaauaucaaaauucatt

SEQ ID NO: 2219 - DNA, 21 bp, Artificial Sequence
  Description of Artificial Sequence: Synthetic oligonucleotide
  Description of Combined DNA/RNA Molecule: Synthetic oligonucleotide
aucaaaauucagaaagucutt

SEQ ID NO: 2220 - DNA, 21 bp, Artificial Sequence
  Description of Artificial Sequence: Synthetic oligonucleotide
  Description of Combined DNA/RNA Molecule: Synthetic oligonucleotide
gaaagucugugaaggagcctt

SEQ ID NO: 2221 - DNA, 21 bp, Artificial Sequence
  Description of Artificial Sequence: Synthetic oligonucleotide
  Description of Combined DNA/RNA Molecule: Synthetic oligonucleotide
gaaggagccgcgugcaagutt

SEQ ID NO: 2222 - DNA, 21 bp, Artificial Sequence
  Description of Artificial Sequence: Synthetic oligonucleotide
  Description of Combined DNA/RNA Molecule: Synthetic oligonucleotide
cgugcaaguguguagaagctt

SEQ ID NO: 2223 - DNA, 21 bp, Artificial Sequence
  Description of Artificial Sequence: Synthetic oligonucleotide
  Description of Combined DNA/RNA Molecule: Synthetic oligonucleotide
guagaagcugauugugggctt

SEQ ID NO: 2224 - DNA, 21 bp, Artificial Sequence
  Description of Artificial Sequence: Synthetic oligonucleotide
  Description of Combined DNA/RNA Molecule: Synthetic oligonucleotide
cugauugugggcaaaugcatt

SEQ ID NO: 2225 - DNA, 21 bp, Artificial Sequence
  Description of Artificial Sequence: Synthetic oligonucleotide
  Description of Combined DNA/RNA Molecule: Synthetic oligonucleotide
gcaaaugcaggaagaauugtt

SEQ ID NO: 2226 - DNA, 21 bp, Artificial Sequence
  Description of Artificial Sequence: Synthetic oligonucleotide
  Description of Combined DNA/RNA Molecule: Synthetic oligonucleotide
gaagaauuggaucugacaatt

SEQ ID NO: 2227 - DNA, 21 bp, Artificial Sequence
  Description of Artificial Sequence: Synthetic oligonucleotide
  Description of Combined DNA/RNA Molecule: Synthetic oligonucleotide
cugacaaucucugcagagatt

SEQ ID NO: 2228 - DNA, 21 bp, Artificial Sequence
  Description of Artificial Sequence: Synthetic oligonucleotide
  Description of Combined DNA/RNA Molecule: Synthetic oligonucleotide
gcagagacaagaaaacaaatt

SEQ ID NO: 2229 - DNA, 21 bp, Artificial Sequence
  Description of Artificial Sequence: Synthetic oligonucleotide
  Description of Combined DNA/RNA Molecule: Synthetic oligonucleotide
caagaaaacaaacagcaugtt

SEQ ID NO: 2230 - DNA, 21 bp, Artificial Sequence
  Description of Artificial Sequence: Synthetic oligonucleotide
  Description of Combined DNA/RNA Molecule: Synthetic oligonucleotide
acagcauguaaaccagagatt

SEQ ID NO: 2231 - DNA, 21 bp, Artificial Sequence
  Description of Artificial Sequence: Synthetic oligonucleotide
  Description of Combined DNA/RNA Molecule: Synthetic oligonucleotide
ccagagauugcauaugcuutt

SEQ ID NO: 2232 - DNA, 21 bp, Artificial Sequence
  Description of Artificial Sequence: Synthetic oligonucleotide
  Description of Combined DNA/RNA Molecule: Synthetic oligonucleotide
gcauaugcuuauaaaguuatt

SEQ ID NO: 2233 - DNA, 21 bp, Artificial Sequence
  Description of Artificial Sequence: Synthetic oligonucleotide
  Description of Combined DNA/RNA Molecule: Synthetic oligonucleotide
uuauaaaguuagcaucacatt

SEQ ID NO: 2234 - DNA, 21 bp, Artificial Sequence
  Description of Artificial Sequence: Synthetic oligonucleotide
  Description of Combined DNA/RNA Molecule: Synthetic oligonucleotide
caucacauccaucacuguatt

SEQ ID NO: 2235 - DNA, 21 bp, Artificial Sequence
  Description of Artificial Sequence: Synthetic oligonucleotide
  Description of Combined DNA/RNA Molecule: Synthetic oligonucleotide
ucacuguagaaaauguuuutt

SEQ ID NO: 2236 - DNA, 21 bp, Artificial Sequence
  Description of Artificial Sequence: Synthetic oligonucleotide
  Description of Combined DNA/RNA Molecule: Synthetic oligonucleotide
agaaaauguuuuugucaagtt

SEQ ID NO: 2237 - DNA, 21 bp, Artificial Sequence
  Description of Artificial Sequence: Synthetic oligonucleotide
  Description of Combined DNA/RNA Molecule: Synthetic oligonucleotide
uuugucaaguacaaggcaatt

SEQ ID NO: 2238 - DNA, 21 bp, Artificial Sequence
  Description of Artificial Sequence: Synthetic oligonucleotide
  Description of Combined DNA/RNA Molecule: Synthetic oligonucleotide
aggcaacccuucuggauautt

SEQ ID NO: 2239 - DNA, 21 bp, Artificial Sequence
  Description of Artificial Sequence: Synthetic oligonucleotide
  Description of Combined DNA/RNA Molecule: Synthetic oligonucleotide
ccuucuggauaucuacaaatt

SEQ ID NO: 2240 - DNA, 21 bp, Artificial Sequence
  Description of Artificial Sequence: Synthetic oligonucleotide
  Description of Combined DNA/RNA Molecule: Synthetic oligonucleotide
uaucuacaaaacuggggaatt

SEQ ID NO: 2241 - DNA, 21 bp, Artificial Sequence
  Description of Artificial Sequence: Synthetic oligonucleotide
  Description of Combined DNA/RNA Molecule: Synthetic oligonucleotide
cuggggaagcuguugcugatt

SEQ ID NO: 2242 - DNA, 21 bp, Artificial Sequence
  Description of Artificial Sequence: Synthetic oligonucleotide
  Description of Combined DNA/RNA Molecule: Synthetic oligonucleotide
cuguugcugagaaagacuctt

SEQ ID NO: 2243 - DNA, 21 bp, Artificial Sequence
  Description of Artificial Sequence: Synthetic oligonucleotide
  Description of Combined DNA/RNA Molecule: Synthetic oligonucleotide
gacucugagauuaccuucatt

SEQ ID NO: 2244 - DNA, 21 bp, Artificial Sequence
  Description of Artificial Sequence: Synthetic oligonucleotide
  Description of Combined DNA/RNA Molecule: Synthetic oligonucleotide
gagauuaccuucauuaaaatt

SEQ ID NO: 2245 - DNA, 21 bp, Artificial Sequence
  Description of Artificial Sequence: Synthetic oligonucleotide
  Description of Combined DNA/RNA Molecule: Synthetic oligonucleotide
auuaaaaagguaaccuguatt

SEQ ID NO: 2246 - DNA, 21 bp, Artificial Sequence
  Description of Artificial Sequence: Synthetic oligonucleotide
  Description of Combined DNA/RNA Molecule: Synthetic oligonucleotide
uaaccuguacuaacgcugatt

SEQ ID NO: 2247 - DNA, 21 bp, Artificial Sequence
  Description of Artificial Sequence: Synthetic oligonucleotide
  Description of Combined DNA/RNA Molecule: Synthetic oligonucleotide
cuaacgcugagcugguaaatt

SEQ ID NO: 2248 - DNA, 21 bp, Artificial Sequence
  Description of Artificial Sequence: Synthetic oligonucleotide
  Description of Combined DNA/RNA Molecule: Synthetic oligonucleotide
gguaaaaggaagacaguactt

SEQ ID NO: 2249 - DNA, 21 bp, Artificial Sequence
  Description of Artificial Sequence: Synthetic oligonucleotide
  Description of Combined DNA/RNA Molecule: Synthetic oligonucleotide
gaagacaguacuuaauuautt

SEQ ID NO: 2250 - DNA, 21 bp, Artificial Sequence
  Description of Artificial Sequence: Synthetic oligonucleotide
  Description of Combined DNA/RNA Molecule: Synthetic oligonucleotide
cuuaauuauggguaaagaatt

SEQ ID NO: 2251 - DNA, 21 bp, Artificial Sequence
  Description of Artificial Sequence: Synthetic oligonucleotide
  Description of Combined DNA/RNA Molecule: Synthetic oligonucleotide
uaaagaagcccuccagauatt

SEQ ID NO: 2252 - DNA, 21 bp, Artificial Sequence
  Description of Artificial Sequence: Synthetic oligonucleotide
  Description of Combined DNA/RNA Molecule: Synthetic oligonucleotide
ccuccagauaaaauacaautt

SEQ ID NO: 2253 - DNA, 21 bp, Artificial Sequence
  Description of Artificial Sequence: Synthetic oligonucleotide
  Description of Combined DNA/RNA Molecule: Synthetic oligonucleotide
aaauacaauuucaguuucatt

SEQ ID NO: 2254 - DNA, 21 bp, Artificial Sequence
  Description of Artificial Sequence: Synthetic oligonucleotide
  Description of Combined DNA/RNA Molecule: Synthetic oligonucleotide
caguuucagguacaucuactt

SEQ ID NO: 2255 - DNA, 21 bp, Artificial Sequence
  Description of Artificial Sequence: Synthetic oligonucleotide
  Description of Combined DNA/RNA Molecule: Synthetic oligonucleotide
gguacaucuacccuuuagatt

SEQ ID NO: 2256 - DNA, 21 bp, Artificial Sequence
  Description of Artificial Sequence: Synthetic oligonucleotide
  Description of Combined DNA/RNA Molecule: Synthetic oligonucleotide
ccuuuagauuccuugaccutt

SEQ ID NO: 2257 - DNA, 21 bp, Artificial Sequence
  Description of Artificial Sequence: Synthetic oligonucleotide
  Description of Combined DNA/RNA Molecule: Synthetic oligonucleotide
ccuugaccuggauugaauatt

SEQ ID NO: 2258 - DNA, 21 bp, Artificial Sequence
  Description of Artificial Sequence: Synthetic oligonucleotide
  Description of Combined DNA/RNA Molecule: Synthetic oligonucleotide
ggauugaauacuggccuagtt

SEQ ID NO: 2259 - DNA, 21 bp, Artificial Sequence
  Description of Artificial Sequence: Synthetic oligonucleotide
  Description of Combined DNA/RNA Molecule: Synthetic oligonucleotide
cuggccuagagacacaacatt

SEQ ID NO: 2260 - DNA, 21 bp, Artificial Sequence
  Description of Artificial Sequence: Synthetic oligonucleotide
  Description of Combined DNA/RNA Molecule: Synthetic oligonucleotide
gagacacaacauguucauctt

SEQ ID NO: 2261 - DNA, 21 bp, Artificial Sequence
  Description of Artificial Sequence: Synthetic oligonucleotide
  Description of Combined DNA/RNA Molecule: Synthetic oligonucleotide
guucaucgugucaagcauutt

SEQ ID NO: 2262 - DNA, 21 bp, Artificial Sequence
  Description of Artificial Sequence: Synthetic oligonucleotide
  Description of Combined DNA/RNA Molecule: Synthetic oligonucleotide
gucaagcauuuuuagcuaatt

SEQ ID NO: 2263 - DNA, 21 bp, Artificial Sequence
  Description of Artificial Sequence: Synthetic oligonucleotide
  Description of Combined DNA/RNA Molecule: Synthetic oligonucleotide
agcuaauuuagaugaauuutt

SEQ ID NO: 2264 - DNA, 21 bp, Artificial Sequence
  Description of Artificial Sequence: Synthetic oligonucleotide
  Description of Combined DNA/RNA Molecule: Synthetic oligonucleotide
agaugaauuugccgaagautt

SEQ ID NO: 2265 - DNA, 21 bp, Artificial Sequence
  Description of Artificial Sequence: Synthetic oligonucleotide
  Description of Combined DNA/RNA Molecule: Synthetic oligonucleotide
ccgaagauaucuuuuuaaatt

SEQ ID NO: 2266 - DNA, 21 bp, Artificial Sequence
  Description of Artificial Sequence: Synthetic oligonucleotide
  Description of Combined DNA/RNA Molecule: Synthetic oligonucleotide
cuuuuuaaauggaugcuaatt

SEQ ID NO: 2267 - DNA, 21 bp, Artificial Sequence
  Description of Artificial Sequence: Synthetic oligonucleotide
  Description of Combined DNA/RNA Molecule: Synthetic oligonucleotide
ggaugcuaaaauuccugaatt

SEQ ID NO: 2268 - DNA, 21 bp, Artificial Sequence
  Description of Artificial Sequence: Synthetic oligonucleotide
  Description of Combined DNA/RNA Molecule: Synthetic oligonucleotide
uaaaauuccugaaguucagtt

SEQ ID NO: 2269 - DNA, 21 bp, Artificial Sequence
  Description of Artificial Sequence: Synthetic oligonucleotide
  Description of Combined DNA/RNA Molecule: Synthetic oligonucleotide
aguucagcugcauacaguutt

SEQ ID NO: 2270 - DNA, 21 bp, Artificial Sequence
  Description of Artificial Sequence: Synthetic oligonucleotide
  Description of Combined DNA/RNA Molecule: Synthetic oligonucleotide
gcauacaguuugcacuuautt

SEQ ID NO: 2271 - DNA, 21 bp, Artificial Sequence
  Description of Artificial Sequence: Synthetic oligonucleotide
  Description of Combined DNA/RNA Molecule: Synthetic oligonucleotide
acuuauggacuccuguugutt

SEQ ID NO: 2272 - DNA, 21 bp, Artificial Sequence
  Description of Artificial Sequence: Synthetic oligonucleotide
  Description of Combined DNA/RNA Molecule: Synthetic oligonucleotide
ggacuccuguuguugaagutt

SEQ ID NO: 2273 - DNA, 21 bp, Artificial Sequence
  Description of Artificial Sequence: Synthetic oligonucleotide
  Description of Combined DNA/RNA Molecule: Synthetic oligonucleotide
uguugaaguucguuuuuuutt

SEQ ID NO: 2274 - DNA, 21 bp, Artificial Sequence
  Description of Artificial Sequence: Synthetic oligonucleotide
  Description of Combined DNA/RNA Molecule: Synthetic oligonucleotide
uuuuuuguuuucuucuuuutt

SEQ ID NO: 2275 - DNA, 21 bp, Artificial Sequence
  Description of Artificial Sequence: Synthetic oligonucleotide
  Description of Combined DNA/RNA Molecule: Synthetic oligonucleotide
ucuucuuuuuuuaaacauutt

SEQ ID NO: 2276 - DNA, 21 bp, Artificial Sequence
  Description of Artificial Sequence: Synthetic oligonucleotide
  Description of Combined DNA/RNA Molecule: Synthetic oligonucleotide
uuuuuaaacauucauagcutt

SEQ ID NO: 2277 - DNA, 21 bp, Artificial Sequence
  Description of Artificial Sequence: Synthetic oligonucleotide
  Description of Combined DNA/RNA Molecule: Synthetic oligonucleotide
auagcuggucuuauuuguatt

SEQ ID NO: 2278 - DNA, 21 bp, Artificial Sequence
  Description of Artificial Sequence: Synthetic oligonucleotide
  Description of Combined DNA/RNA Molecule: Synthetic oligonucleotide
gucuuauuuguaaagcucatt

SEQ ID NO: 2279 - DNA, 21 bp, Artificial Sequence
  Description of Artificial Sequence: Synthetic oligonucleotide
  Description of Combined DNA/RNA Molecule: Synthetic oligonucleotide
aaagcucacuuuacuuagatt

SEQ ID NO: 2280 - DNA, 21 bp, Artificial Sequence
  Description of Artificial Sequence: Synthetic oligonucleotide
  Description of Combined DNA/RNA Molecule: Synthetic oligonucleotide
acuuagaauuaguggcacutt

SEQ ID NO: 2281 - DNA, 21 bp, Artificial Sequence
  Description of Artificial Sequence: Synthetic oligonucleotide
  Description of Combined DNA/RNA Molecule: Synthetic oligonucleotide
aguggcacuugcuuuuauutt

SEQ ID NO: 2282 - DNA, 21 bp, Artificial Sequence
  Description of Artificial Sequence: Synthetic oligonucleotide
  Description of Combined DNA/RNA Molecule: Synthetic oligonucleotide
gcuuuuauuagagaaugautt

SEQ ID NO: 2283 - DNA, 21 bp, Artificial Sequence
  Description of Artificial Sequence: Synthetic oligonucleotide
  Description of Combined DNA/RNA Molecule: Synthetic oligonucleotide
gagaaugauuucaaaugcutt

SEQ ID NO: 2284 - DNA, 21 bp, Artificial Sequence
  Description of Artificial Sequence: Synthetic oligonucleotide
  Description of Combined DNA/RNA Molecule: Synthetic oligonucleotide
uuucaaaugcuguaacuuutt

SEQ ID NO: 2285 - DNA, 21 bp, Artificial Sequence
  Description of Artificial Sequence: Synthetic oligonucleotide
  Description of Combined DNA/RNA Molecule: Synthetic oligonucleotide
guaacuuucugaaauaacatt

SEQ ID NO: 2286 - DNA, 21 bp, Artificial Sequence
  Description of Artificial Sequence: Synthetic oligonucleotide
  Description of Combined DNA/RNA Molecule: Synthetic oligonucleotide
gaaauaacauggccuuggatt

SEQ ID NO: 2287 - DNA, 21 bp, Artificial Sequence
  Description of Artificial Sequence: Synthetic oligonucleotide
  Description of Combined DNA/RNA Molecule: Synthetic oligonucleotide
ccuuggagggcaugaagactt

SEQ ID NO: 2288 - DNA, 21 bp, Artificial Sequence
  Description of Artificial Sequence: Synthetic oligonucleotide
  Description of Combined DNA/RNA Molecule: Synthetic oligonucleotide
agggcaugaagacagauactt

SEQ ID NO: 2289 - DNA, 21 bp, Artificial Sequence
  Description of Artificial Sequence: Synthetic oligonucleotide
  Description of Combined DNA/RNA Molecule: Synthetic oligonucleotide
gauacuccuccaagguuautt

SEQ ID NO: 2290 - DNA, 21 bp, Artificial Sequence
  Description of Artificial Sequence: Synthetic oligonucleotide
  Description of Combined DNA/RNA Molecule: Synthetic oligonucleotide
ccuccaagguuauuggacatt

SEQ ID NO: 2291 - DNA, 21 bp, Artificial Sequence
  Description of Artificial Sequence: Synthetic oligonucleotide
  Description of Combined DNA/RNA Molecule: Synthetic oligonucleotide
ggacaccggaaacaauaaatt

SEQ ID NO: 2292 - DNA, 21 bp, Artificial Sequence
  Description of Artificial Sequence: Synthetic oligonucleotide
  Description of Combined DNA/RNA Molecule: Synthetic oligonucleotide
gaaacaauaaauuggaacatt

SEQ ID NO: 2293 - DNA, 21 bp, Artificial Sequence
  Description of Artificial Sequence: Synthetic oligonucleotide
  Description of Combined DNA/RNA Molecule: Synthetic oligonucleotide
auuggaacaccuccucaaatt

SEQ ID NO: 2294 - DNA, 21 bp, Artificial Sequence
  Description of Artificial Sequence: Synthetic oligonucleotide
  Description of Combined DNA/RNA Molecule: Synthetic oligonucleotide
uccucaaaccuaccacucatt

SEQ ID NO: 2295 - DNA, 21 bp, Artificial Sequence
  Description of Artificial Sequence: Synthetic oligonucleotide
  Description of Combined DNA/RNA Molecule: Synthetic oligonucleotide
cuaccacucaggaauguuutt

SEQ ID NO: 2296 - DNA, 21 bp, Artificial Sequence
  Description of Artificial Sequence: Synthetic oligonucleotide
  Description of Combined DNA/RNA Molecule: Synthetic oligonucleotide
aauguuugcuggggccgaatt

SEQ ID NO: 2297 - DNA, 21 bp, Artificial Sequence
  Description of Artificial Sequence: Synthetic oligonucleotide
  Description of Combined DNA/RNA Molecule: Synthetic oligonucleotide
ugcuggggccgaaagaacatt

SEQ ID NO: 2298 - DNA, 21 bp, Artificial Sequence
  Description of Artificial Sequence: Synthetic oligonucleotide
  Description of Combined DNA/RNA Molecule: Synthetic oligonucleotide
aaagaacaguccauugaaatt

SEQ ID NO: 2299 - DNA, 21 bp, Artificial Sequence
  Description of Artificial Sequence: Synthetic oligonucleotide
  Description of Combined DNA/RNA Molecule: Synthetic oligonucleotide
cauugaaagggaguauuactt

SEQ ID NO: 2300 - DNA, 21 bp, Artificial Sequence
  Description of Artificial Sequence: Synthetic oligonucleotide
  Description of Combined DNA/RNA Molecule: Synthetic oligonucleotide
ggaguauuacaaaaacaugtt

SEQ ID NO: 2301 - DNA, 21 bp, Artificial Sequence
  Description of Artificial Sequence: Synthetic oligonucleotide
  Description of Combined DNA/RNA Molecule: Synthetic oligonucleotide
aaaacauggccuuugcuugtt

SEQ ID NO: 2302 - DNA, 21 bp, Artificial Sequence
  Description of Artificial Sequence: Synthetic oligonucleotide
  Description of Combined DNA/RNA Molecule: Synthetic oligonucleotide
gccuuugcuugaaagaaaatt

SEQ ID NO: 2303 - DNA, 21 bp, Artificial Sequence
  Description of Artificial Sequence: Synthetic oligonucleotide
  Description of Combined DNA/RNA Molecule: Synthetic oligonucleotide
gaaagaaaauaccaaggaatt

SEQ ID NO: 2304 - DNA, 21 bp, Artificial Sequence
  Description of Artificial Sequence: Synthetic oligonucleotide
  Description of Combined DNA/RNA Molecule: Synthetic oligonucleotide
ccaaggaacaggaaacugatt

SEQ ID NO: 2305 - DNA, 21 bp, Artificial Sequence
  Description of Artificial Sequence: Synthetic oligonucleotide
  Description of Combined DNA/RNA Molecule: Synthetic oligonucleotide
aacugaucauuaaagccugtt

SEQ ID NO: 2306 - DNA, 21 bp, Artificial Sequence
  Description of Artificial Sequence: Synthetic oligonucleotide
  Description of Combined DNA/RNA Molecule: Synthetic oligonucleotide
uagcaggaaaccacggauatt

SEQ ID NO: 2307 - DNA, 21 bp, Artificial Sequence
  Description of Artificial Sequence: Synthetic oligonucleotide
  Description of Combined DNA/RNA Molecule: Synthetic oligonucleotide
uuggagguagcaggaaacctt

SEQ ID NO: 2308 - DNA, 21 bp, Artificial Sequence
  Description of Artificial Sequence: Synthetic oligonucleotide
  Description of Combined DNA/RNA Molecule: Synthetic oligonucleotide
aaaggcccaugguuggaggtt

SEQ ID NO: 2309 - DNA, 21 bp, Artificial Sequence
  Description of Artificial Sequence: Synthetic oligonucleotide
  Description of Combined DNA/RNA Molecule: Synthetic oligonucleotide
aaguauucccaaaaggccctt

SEQ ID NO: 2310 - DNA, 21 bp, Artificial Sequence
  Description of Artificial Sequence: Synthetic oligonucleotide
  Description of Combined DNA/RNA Molecule: Synthetic oligonucleotide
uuaaaaaacaaaguauucctt

SEQ ID NO: 2311 - DNA, 21 bp, Artificial Sequence
  Description of Artificial Sequence: Synthetic oligonucleotide
  Description of Combined DNA/RNA Molecule: Synthetic oligonucleotide
ggaagauuaaaaaacaaagtt

SEQ ID NO: 2312 - DNA, 21 bp, Artificial Sequence
  Description of Artificial Sequence: Synthetic oligonucleotide
  Description of Combined DNA/RNA Molecule: Synthetic oligonucleotide
ccagguuuuccccaggaagtt

SEQ ID NO: 2313 - DNA, 21 bp, Artificial Sequence
  Description of Artificial Sequence: Synthetic oligonucleotide
  Description of Combined DNA/RNA Molecule: Synthetic oligonucleotide
uccuguccccagguuuucctt

SEQ ID NO: 2314 - DNA, 21 bp, Artificial Sequence
  Description of Artificial Sequence: Synthetic oligonucleotide
  Description of Combined DNA/RNA Molecule: Synthetic oligonucleotide
auauguuugcuccuguccctt

SEQ ID NO: 2315 - DNA, 21 bp, Artificial Sequence
  Description of Artificial Sequence: Synthetic oligonucleotide
  Description of Combined DNA/RNA Molecule: Synthetic oligonucleotide
cugaaaugacauauguuugtt

SEQ ID NO: 2316 - DNA, 21 bp, Artificial Sequence
  Description of Artificial Sequence: Synthetic oligonucleotide
  Description of Combined DNA/RNA Molecule: Synthetic oligonucleotide
uauuuuuggugcugaaaugtt

SEQ ID NO: 2317 - DNA, 21 bp, Artificial Sequence
  Description of Artificial Sequence: Synthetic oligonucleotide
  Description of Combined DNA/RNA Molecule: Synthetic oligonucleotide
cacggaauauuuuuggugctt

SEQ ID NO: 2318 - DNA, 21 bp, Artificial Sequence
  Description of Artificial Sequence: Synthetic oligonucleotide
  Description of Combined DNA/RNA Molecule: Synthetic oligonucleotide
uucagaugcuccaacacggtt

SEQ ID NO: 2319 - DNA, 21 bp, Artificial Sequence
  Description of Artificial Sequence: Synthetic oligonucleotide
  Description of Combined DNA/RNA Molecule: Synthetic oligonucleotide
caauauuuucagaugcucctt

SEQ ID NO: 2320 - DNA, 21 bp, Artificial Sequence
  Description of Artificial Sequence: Synthetic oligonucleotide
  Description of Combined DNA/RNA Molecule: Synthetic oligonucleotide
cuugaaucacaauauuuuctt

SEQ ID NO: 2321 - DNA, 21 bp, Artificial Sequence
  Description of Artificial Sequence: Synthetic oligonucleotide
  Description of Combined DNA/RNA Molecule: Synthetic oligonucleotide
guauccauaaacuugaauctt

SEQ ID NO: 2322 - DNA, 21 bp, Artificial Sequence
  Description of Artificial Sequence: Synthetic oligonucleotide
  Description of Combined DNA/RNA Molecule: Synthetic oligonucleotide
caaaugcuucaguguaucctt

SEQ ID NO: 2323 - DNA, 21 bp, Artificial Sequence
  Description of Artificial Sequence: Synthetic oligonucleotide
  Description of Combined DNA/RNA Molecule: Synthetic oligonucleotide
uuguugcaucaaaugcuuctt

SEQ ID NO: 2324 - DNA, 21 bp, Artificial Sequence
  Description of Artificial Sequence: Synthetic oligonucleotide
  Description of Combined DNA/RNA Molecule: Synthetic oligonucleotide
uuuaauagagauuguugcatt

SEQ ID NO: 2325 - DNA, 21 bp, Artificial Sequence
  Description of Artificial Sequence: Synthetic oligonucleotide
  Description of Combined DNA/RNA Molecule: Synthetic oligonucleotide
auaacuuuuaauagagauutt

SEQ ID NO: 2326 - DNA, 21 bp, Artificial Sequence
  Description of Artificial Sequence: Synthetic oligonucleotide
  Description of Combined DNA/RNA Molecule: Synthetic oligonucleotide
uuuuuuaucaggauaacuutt

SEQ ID NO: 2327 - DNA, 21 bp, Artificial Sequence
  Description of Artificial Sequence: Synthetic oligonucleotide
  Description of Combined DNA/RNA Molecule: Synthetic oligonucleotide
uaacuaaauuuuuuaucagtt

SEQ ID NO: 2328 - DNA, 21 bp, Artificial Sequence
  Description of Artificial Sequence: Synthetic oligonucleotide
  Description of Combined DNA/RNA Molecule: Synthetic oligonucleotide
uggccugaggaguaacuaatt

SEQ ID NO: 2329 - DNA, 21 bp, Artificial Sequence
  Description of Artificial Sequence: Synthetic oligonucleotide
  Description of Combined DNA/RNA Molecule: Synthetic oligonucleotide
aaaugaacauggccugaggtt

SEQ ID NO: 2330 - DNA, 21 bp, Artificial Sequence
  Description of Artificial Sequence: Synthetic oligonucleotide
  Description of Combined DNA/RNA Molecule: Synthetic oligonucleotide
uucucugaggauaaaugaatt

SEQ ID NO: 2331 - DNA, 21 bp, Artificial Sequence
  Description of Artificial Sequence: Synthetic oligonucleotide
  Description of Combined DNA/RNA Molecule: Synthetic oligonucleotide
uuggaauuuauucucugagtt

SEQ ID NO: 2332 - DNA, 21 bp, Artificial Sequence
  Description of Artificial Sequence: Synthetic oligonucleotide
  Description of Combined DNA/RNA Molecule: Synthetic oligonucleotide
cagaguuuuggaauuuauutt

SEQ ID NO: 2333 - DNA, 21 bp, Artificial Sequence
  Description of Artificial Sequence: Synthetic oligonucleotide
  Description of Combined DNA/RNA Molecule: Synthetic oligonucleotide
uauuguuaagauugcagagtt

SEQ ID NO: 2334 - DNA, 21 bp, Artificial Sequence
  Description of Artificial Sequence: Synthetic oligonucleotide
  Description of Combined DNA/RNA Molecule: Synthetic oligonucleotide
uuuugguuguauuguuaagtt

SEQ ID NO: 2335 - DNA, 21 bp, Artificial Sequence
  Description of Artificial Sequence: Synthetic oligonucleotide
  Description of Combined DNA/RNA Molecule: Synthetic oligonucleotide
caggcaauuguuuugguugtt

SEQ ID NO: 2336 - DNA, 21 bp, Artificial Sequence
  Description of Artificial Sequence: Synthetic oligonucleotide
  Description of Combined DNA/RNA Molecule: Synthetic oligonucleotide
uuuguccuccaggcaauugtt

SEQ ID NO: 2337 - DNA, 21 bp, Artificial Sequence
  Description of Artificial Sequence: Synthetic oligonucleotide
  Description of Combined DNA/RNA Molecule: Synthetic oligonucleotide
aagaaacuggguuuugucctt

SEQ ID NO: 2338 - DNA, 21 bp, Artificial Sequence
  Description of Artificial Sequence: Synthetic oligonucleotide
  Description of Combined DNA/RNA Molecule: Synthetic oligonucleotide
aauacacauaagaaacuggtt

SEQ ID NO: 2339 - DNA, 21 bp, Artificial Sequence
  Description of Artificial Sequence: Synthetic oligonucleotide
  Description of Combined DNA/RNA Molecule: Synthetic oligonucleotide
acaacuuccaaauacacautt

SEQ ID NO: 2340 - DNA, 21 bp, Artificial Sequence
  Description of Artificial Sequence: Synthetic oligonucleotide
  Description of Combined DNA/RNA Molecule: Synthetic oligonucleotide
augcuuugauacaacuucctt

SEQ ID NO: 2341 - DNA, 21 bp, Artificial Sequence
  Description of Artificial Sequence: Synthetic oligonucleotide
  Description of Combined DNA/RNA Molecule: Synthetic oligonucleotide
uugaaaaaugcuuugauactt

SEQ ID NO: 2342 - DNA, 21 bp, Artificial Sequence
  Description of Artificial Sequence: Synthetic oligonucleotide
  Description of Combined DNA/RNA Molecule: Synthetic oligonucleotide
uucuuuuugauuuugaaaatt

SEQ ID NO: 2343 - DNA, 21 bp, Artificial Sequence
  Description of Artificial Sequence: Synthetic oligonucleotide
  Description of Combined DNA/RNA Molecule: Synthetic oligonucleotide
guuauuggcauucuuuuugtt

SEQ ID NO: 2344 - DNA, 21 bp, Artificial Sequence
  Description of Artificial Sequence: Synthetic oligonucleotide
  Description of Combined DNA/RNA Molecule: Synthetic oligonucleotide
auugucauagguuauuggctt

SEQ ID NO: 2345 - DNA, 21 bp, Artificial Sequence
  Description of Artificial Sequence: Synthetic oligonucleotide
  Description of Combined DNA/RNA Molecule: Synthetic oligonucleotide
agaaauccauugucauaggtt

SEQ ID NO: 2346 - DNA, 21 bp, Artificial Sequence
  Description of Artificial Sequence: Synthetic oligonucleotide
  Description of Combined DNA/RNA Molecule: Synthetic oligonucleotide
augaaugaagagaaauccatt

SEQ ID NO: 2347 - DNA, 21 bp, Artificial Sequence
  Description of Artificial Sequence: Synthetic oligonucleotide
  Description of Combined DNA/RNA Molecule: Synthetic oligonucleotide
agguuugucuguaugaaugtt

SEQ ID NO: 2348 - DNA, 21 bp, Artificial Sequence
  Description of Artificial Sequence: Synthetic oligonucleotide
  Description of Combined DNA/RNA Molecule: Synthetic oligonucleotide
guauaaacagguuugucugtt

SEQ ID NO: 2349 - DNA, 21 bp, Artificial Sequence
  Description of Artificial Sequence: Synthetic oligonucleotide
  Description of Combined DNA/RNA Molecule: Synthetic oligonucleotide
acuggucuggaguauaaactt

SEQ ID NO: 2350 - DNA, 21 bp, Artificial Sequence
  Description of Artificial Sequence: Synthetic oligonucleotide
  Description of Combined DNA/RNA Molecule: Synthetic oligonucleotide
aacuuuuacugacuggucutt

SEQ ID NO: 2351 - DNA, 21 bp, Artificial Sequence
  Description of Artificial Sequence: Synthetic oligonucleotide
  Description of Combined DNA/RNA Molecule: Synthetic oligonucleotide
auaaacucuaacuuuuacutt

SEQ ID NO: 2352 - DNA, 21 bp, Artificial Sequence
  Description of Artificial Sequence: Synthetic oligonucleotide
  Description of Combined DNA/RNA Molecule: Synthetic oligonucleotide
cauucaacgaauaaacucutt

SEQ ID NO: 2353 - DNA, 21 bp, Artificial Sequence
  Description of Artificial Sequence: Synthetic oligonucleotide
  Description of Combined DNA/RNA Molecule: Synthetic oligonucleotide
uucaagucgucauucaacgtt

SEQ ID NO: 2354 - DNA, 21 bp, Artificial Sequence
  Description of Artificial Sequence: Synthetic oligonucleotide
  Description of Combined DNA/RNA Molecule: Synthetic oligonucleotide
ucuuuuggcuggcuucaagtt

SEQ ID NO: 2355 - DNA, 21 bp, Artificial Sequence
  Description of Artificial Sequence: Synthetic oligonucleotide
  Description of Combined DNA/RNA Molecule: Synthetic oligonucleotide
caguuucucuuuuggcuggtt

SEQ ID NO: 2356 - DNA, 21 bp, Artificial Sequence
  Description of Artificial Sequence: Synthetic oligonucleotide
  Description of Combined DNA/RNA Molecule: Synthetic oligonucleotide
augaaaguuaagacaguuutt

SEQ ID NO: 2357 - DNA, 21 bp, Artificial Sequence
  Description of Artificial Sequence: Synthetic oligonucleotide
  Description of Combined DNA/RNA Molecule: Synthetic oligonucleotide
uucaggaucuaugaaaguutt

SEQ ID NO: 2358 - DNA, 21 bp, Artificial Sequence
  Description of Artificial Sequence: Synthetic oligonucleotide
  Description of Combined DNA/RNA Molecule: Synthetic oligonucleotide
ugauccuucaggaucuaugtt

SEQ ID NO: 2359 - DNA, 21 bp, Artificial Sequence
  Description of Artificial Sequence: Synthetic oligonucleotide
  Description of Combined DNA/RNA Molecule: Synthetic oligonucleotide
ugucaacuucugauccuuctt

SEQ ID NO: 2360 - DNA, 21 bp, Artificial Sequence
  Description of Artificial Sequence: Synthetic oligonucleotide
  Description of Combined DNA/RNA Molecule: Synthetic oligonucleotide
aauuucuucuaccaugucatt

SEQ ID NO: 2361 - DNA, 21 bp, Artificial Sequence
  Description of Artificial Sequence: Synthetic oligonucleotide
  Description of Combined DNA/RNA Molecule: Synthetic oligonucleotide
caauaugaucaauuucuuctt

SEQ ID NO: 2362 - DNA, 21 bp, Artificial Sequence
  Description of Artificial Sequence: Synthetic oligonucleotide
  Description of Combined DNA/RNA Molecule: Synthetic oligonucleotide
agauaauuccaauaugauctt

SEQ ID NO: 2363 - DNA, 21 bp, Artificial Sequence
  Description of Artificial Sequence: Synthetic oligonucleotide
  Description of Combined DNA/RNA Molecule: Synthetic oligonucleotide
caggaaaagagauaauucctt

SEQ ID NO: 2364 - DNA, 21 bp, Artificial Sequence
  Description of Artificial Sequence: Synthetic oligonucleotide
  Description of Combined DNA/RNA Molecule: Synthetic oligonucleotide
cuugaagucaggaaaagagtt

SEQ ID NO: 2365 - DNA, 21 bp, Artificial Sequence
  Description of Artificial Sequence: Synthetic oligonucleotide
  Description of Combined DNA/RNA Molecule: Synthetic oligonucleotide
uuagacggaaucuugaagutt

SEQ ID NO: 2366 - DNA, 21 bp, Artificial Sequence
  Description of Artificial Sequence: Synthetic oligonucleotide
  Description of Combined DNA/RNA Molecule: Synthetic oligonucleotide
cauaucuaggauuagacggtt

SEQ ID NO: 2367 - DNA, 21 bp, Artificial Sequence
  Description of Artificial Sequence: Synthetic oligonucleotide
  Description of Combined DNA/RNA Molecule: Synthetic oligonucleotide
uccacauaccauaucuaggtt

SEQ ID NO: 2368 - DNA, 21 bp, Artificial Sequence
  Description of Artificial Sequence: Synthetic oligonucleotide
  Description of Combined DNA/RNA Molecule: Synthetic oligonucleotide
uuagccuugaucguccacatt

SEQ ID NO: 2369 - DNA, 21 bp, Artificial Sequence
  Description of Artificial Sequence: Synthetic oligonucleotide
  Description of Combined DNA/RNA Molecule: Synthetic oligonucleotide
uuauauuuagccuugaucgtt

SEQ ID NO: 2370 - DNA, 21 bp, Artificial Sequence
  Description of Artificial Sequence: Synthetic oligonucleotide
  Description of Combined DNA/RNA Molecule: Synthetic oligonucleotide
ugaaaaguccucuuuauautt

SEQ ID NO: 2371 - DNA, 21 bp, Artificial Sequence
  Description of Artificial Sequence: Synthetic oligonucleotide
  Description of Combined DNA/RNA Molecule: Synthetic oligonucleotide
caguuguugaaaaguccuctt

SEQ ID NO: 2372 - DNA, 21 bp, Artificial Sequence
  Description of Artificial Sequence: Synthetic oligonucleotide
  Description of Combined DNA/RNA Molecule: Synthetic oligonucleotide
aaauaugcgguuccaguugtt

SEQ ID NO: 2373 - DNA, 21 bp, Artificial Sequence
  Description of Artificial Sequence: Synthetic oligonucleotide
  Description of Combined DNA/RNA Molecule: Synthetic oligonucleotide
uuuaacuucaaaauaugcgtt

SEQ ID NO: 2374 - DNA, 21 bp, Artificial Sequence
  Description of Artificial Sequence: Synthetic oligonucleotide
  Description of Combined DNA/RNA Molecule: Synthetic oligonucleotide
aagacauauucuuuaacuutt

SEQ ID NO: 2375 - DNA, 21 bp, Artificial Sequence
  Description of Artificial Sequence: Synthetic oligonucleotide
  Description of Combined DNA/RNA Molecule: Synthetic oligonucleotide
aauguggcaagacauauuctt

SEQ ID NO: 2376 - DNA, 21 bp, Artificial Sequence
  Description of Artificial Sequence: Synthetic oligonucleotide
  Description of Combined DNA/RNA Molecule: Synthetic oligonucleotide
uugagacagaaaaauguggtt

SEQ ID NO: 2377 - DNA, 21 bp, Artificial Sequence
  Description of Artificial Sequence: Synthetic oligonucleotide
  Description of Combined DNA/RNA Molecule: Synthetic oligonucleotide
ucuggcucgauugagacagtt

SEQ ID NO: 2378 - DNA, 21 bp, Artificial Sequence
  Description of Artificial Sequence: Synthetic oligonucleotide
  Description of Combined DNA/RNA Molecule: Synthetic oligonucleotide
uuauauucuggcucgauugtt

SEQ ID NO: 2379 - DNA, 21 bp, Artificial Sequence
  Description of Artificial Sequence: Synthetic oligonucleotide
  Description of Combined DNA/RNA Molecule: Synthetic oligonucleotide
aaccaaugaaauuauauuctt

SEQ ID NO: 2380 - DNA, 21 bp, Artificial Sequence
  Description of Artificial Sequence: Synthetic oligonucleotide
  Description of Combined DNA/RNA Molecule: Synthetic oligonucleotide
uaaaguucuuguaaccaautt

SEQ ID NO: 2381 - DNA, 21 bp, Artificial Sequence
  Description of Artificial Sequence: Synthetic oligonucleotide
  Description of Combined DNA/RNA Molecule: Synthetic oligonucleotide
ucaaaauucuuaaaguucutt

SEQ ID NO: 2382 - DNA, 21 bp, Artificial Sequence
  Description of Artificial Sequence: Synthetic oligonucleotide
  Description of Combined DNA/RNA Molecule: Synthetic oligonucleotide
uauaguaauuucaaaauuctt

SEQ ID NO: 2383 - DNA, 21 bp, Artificial Sequence
  Description of Artificial Sequence: Synthetic oligonucleotide
  Description of Combined DNA/RNA Molecule: Synthetic oligonucleotide
uugcuuuuauaguaauuuctt

SEQ ID NO: 2384 - DNA, 21 bp, Artificial Sequence
  Description of Artificial Sequence: Synthetic oligonucleotide
  Description of Combined DNA/RNA Molecule: Synthetic oligonucleotide
uauaaaaauaucuugcuuutt

SEQ ID NO: 2385 - DNA, 21 bp, Artificial Sequence
  Description of Artificial Sequence: Synthetic oligonucleotide
  Description of Combined DNA/RNA Molecule: Synthetic oligonucleotide
uacuuuauuauaaaaauautt

SEQ ID NO: 2386 - DNA, 21 bp, Artificial Sequence
  Description of Artificial Sequence: Synthetic oligonucleotide
  Description of Combined DNA/RNA Molecule: Synthetic oligonucleotide
ucagccucagugacuacuutt

SEQ ID NO: 2387 - DNA, 21 bp, Artificial Sequence
  Description of Artificial Sequence: Synthetic oligonucleotide
  Description of Combined DNA/RNA Molecule: Synthetic oligonucleotide
auaaacgucagccucagugtt

SEQ ID NO: 2388 - DNA, 21 bp, Artificial Sequence
  Description of Artificial Sequence: Synthetic oligonucleotide
  Description of Combined DNA/RNA Molecule: Synthetic oligonucleotide
uccaaaugugauauaaacgtt

SEQ ID NO: 2389 - DNA, 21 bp, Artificial Sequence
  Description of Artificial Sequence: Synthetic oligonucleotide
  Description of Combined DNA/RNA Molecule: Synthetic oligonucleotide
uucucuuauuccaaaugugtt

SEQ ID NO: 2390 - DNA, 21 bp, Artificial Sequence
  Description of Artificial Sequence: Synthetic oligonucleotide
  Description of Combined DNA/RNA Molecule: Synthetic oligonucleotide
uuuuaagucuucucuuauutt

SEQ ID NO: 2391 - DNA, 21 bp, Artificial Sequence
  Description of Artificial Sequence: Synthetic oligonucleotide
  Description of Combined DNA/RNA Molecule: Synthetic oligonucleotide
uuuuugaucaucuuuuaagtt

SEQ ID NO: 2392 - DNA, 21 bp, Artificial Sequence
  Description of Artificial Sequence: Synthetic oligonucleotide
  Description of Combined DNA/RNA Molecule: Synthetic oligonucleotide
ucauuucuuuuugaucauctt

SEQ ID NO: 2393 - DNA, 21 bp, Artificial Sequence
  Description of Artificial Sequence: Synthetic oligonucleotide
  Description of Combined DNA/RNA Molecule: Synthetic oligonucleotide
auugcuguuugcaucauuutt

SEQ ID NO: 2394 - DNA, 21 bp, Artificial Sequence
  Description of Artificial Sequence: Synthetic oligonucleotide
  Description of Combined DNA/RNA Molecule: Synthetic oligonucleotide
uuguguuuugcauugcugutt

SEQ ID NO: 2395 - DNA, 21 bp, Artificial Sequence
  Description of Artificial Sequence: Synthetic oligonucleotide
  Description of Combined DNA/RNA Molecule: Synthetic oligonucleotide
uuuaucaacauuguguuuutt

SEQ ID NO: 2396 - DNA, 21 bp, Artificial Sequence
  Description of Artificial Sequence: Synthetic oligonucleotide
  Description of Combined DNA/RNA Molecule: Synthetic oligonucleotide
auuccauuuaucaacauugtt

SEQ ID NO: 2397 - DNA, 21 bp, Artificial Sequence
  Description of Artificial Sequence: Synthetic oligonucleotide
  Description of Combined DNA/RNA Molecule: Synthetic oligonucleotide
augugacuugagcaauucctt

SEQ ID NO: 2398 - DNA, 21 bp, Artificial Sequence
  Description of Artificial Sequence: Synthetic oligonucleotide
  Description of Combined DNA/RNA Molecule: Synthetic oligonucleotide
aaucaaaugugacuugagctt

SEQ ID NO: 2399 - DNA, 21 bp, Artificial Sequence
  Description of Artificial Sequence: Synthetic oligonucleotide
  Description of Combined DNA/RNA Molecule: Synthetic oligonucleotide
ugcuguuucagaaucaaautt

SEQ ID NO: 2400 - DNA, 21 bp, Artificial Sequence
  Description of Artificial Sequence: Synthetic oligonucleotide
  Description of Combined DNA/RNA Molecule: Synthetic oligonucleotide
uucuuugacugcuguuucatt

SEQ ID NO: 2401 - DNA, 21 bp, Artificial Sequence
  Description of Artificial Sequence: Synthetic oligonucleotide
  Description of Combined DNA/RNA Molecule: Synthetic oligonucleotide
guaguaugacaguucuuugtt

SEQ ID NO: 2402 - DNA, 21 bp, Artificial Sequence
  Description of Artificial Sequence: Synthetic oligonucleotide
  Description of Combined DNA/RNA Molecule: Synthetic oligonucleotide
ucuucuaaacuguaguaugtt

SEQ ID NO: 2403 - DNA, 21 bp, Artificial Sequence
  Description of Artificial Sequence: Synthetic oligonucleotide
  Description of Combined DNA/RNA Molecule: Synthetic oligonucleotide
guuuaaaucuucuaaacugtt

SEQ ID NO: 2404 - DNA, 21 bp, Artificial Sequence
  Description of Artificial Sequence: Synthetic oligonucleotide
  Description of Combined DNA/RNA Molecule: Synthetic oligonucleotide
uaaagguacuuguuguuuatt

SEQ ID NO: 2405 - DNA, 21 bp, Artificial Sequence
  Description of Artificial Sequence: Synthetic oligonucleotide
  Description of Combined DNA/RNA Molecule: Synthetic oligonucleotide
agcaauauaaagguacuugtt

SEQ ID NO: 2406 - DNA, 21 bp, Artificial Sequence
  Description of Artificial Sequence: Synthetic oligonucleotide
  Description of Combined DNA/RNA Molecule: Synthetic oligonucleotide
uaugacuguuacagcaauatt

SEQ ID NO: 2407 - DNA, 21 bp, Artificial Sequence
  Description of Artificial Sequence: Synthetic oligonucleotide
  Description of Combined DNA/RNA Molecule: Synthetic oligonucleotide
uguagacucuaugacuguutt

SEQ ID NO: 2408 - DNA, 21 bp, Artificial Sequence
  Description of Artificial Sequence: Synthetic oligonucleotide
  Description of Combined DNA/RNA Molecule: Synthetic oligonucleotide
aaauccaccuguagacucutt

SEQ ID NO: 2409 - DNA, 21 bp, Artificial Sequence
  Description of Artificial Sequence: Synthetic oligonucleotide
  Description of Combined DNA/RNA Molecule: Synthetic oligonucleotide
cugccucuucagaaaaucctt

SEQ ID NO: 2410 - DNA, 21 bp, Artificial Sequence
  Description of Artificial Sequence: Synthetic oligonucleotide
  Description of Combined DNA/RNA Molecule: Synthetic oligonucleotide
cagguauuucugccucuuctt

SEQ ID NO: 2411 - DNA, 21 bp, Artificial Sequence
  Description of Artificial Sequence: Synthetic oligonucleotide
  Description of Combined DNA/RNA Molecule: Synthetic oligonucleotide
uuugaugccagguauuucutt

SEQ ID NO: 2412 - DNA, 21 bp, Artificial Sequence
  Description of Artificial Sequence: Synthetic oligonucleotide
  Description of Combined DNA/RNA Molecule: Synthetic oligonucleotide
gagaggacauauuugaugctt

SEQ ID NO: 2413 - DNA, 21 bp, Artificial Sequence
  Description of Artificial Sequence: Synthetic oligonucleotide
  Description of Combined DNA/RNA Molecule: Synthetic oligonucleotide
uuuguagggagagaggacatt

SEQ ID NO: 2414 - DNA, 21 bp, Artificial Sequence
  Description of Artificial Sequence: Synthetic oligonucleotide
  Description of Combined DNA/RNA Molecule: Synthetic oligonucleotide
aggaguagcaaccaaauuctt

SEQ ID NO: 2415 - DNA, 21 bp, Artificial Sequence
  Description of Artificial Sequence: Synthetic oligonucleotide
  Description of Combined DNA/RNA Molecule: Synthetic oligonucleotide
ucaggaaaagaggaguagctt

SEQ ID NO: 2416 - DNA, 21 bp, Artificial Sequence
  Description of Artificial Sequence: Synthetic oligonucleotide
  Description of Combined DNA/RNA Molecule: Synthetic oligonucleotide
ccaggcuucaggaaaagagtt

SEQ ID NO: 2417 - DNA, 21 bp, Artificial Sequence
  Description of Artificial Sequence: Synthetic oligonucleotide
  Description of Combined DNA/RNA Molecule: Synthetic oligonucleotide
ugggauauggaaucccaggtt

SEQ ID NO: 2418 - DNA, 21 bp, Artificial Sequence
  Description of Artificial Sequence: Synthetic oligonucleotide
  Description of Combined DNA/RNA Molecule: Synthetic oligonucleotide
ugcaccuugaugggauaugtt

SEQ ID NO: 2419 - DNA, 21 bp, Artificial Sequence
  Description of Artificial Sequence: Synthetic oligonucleotide
  Description of Combined DNA/RNA Molecule: Synthetic oligonucleotide
uuaaccugcaccuugauggtt

SEQ ID NO: 2420 - DNA, 21 bp, Artificial Sequence
  Description of Artificial Sequence: Synthetic oligonucleotide
  Description of Combined DNA/RNA Molecule: Synthetic oligonucleotide
caagcgaaucuuuaaccugtt

SEQ ID NO: 2421 - DNA, 21 bp, Artificial Sequence
  Description of Artificial Sequence: Synthetic oligonucleotide
  Description of Combined DNA/RNA Molecule: Synthetic oligonucleotide
uaccaacuggucaagcgaatt

SEQ ID NO: 2422 - DNA, 21 bp, Artificial Sequence
  Description of Artificial Sequence: Synthetic oligonucleotide
  Description of Combined DNA/RNA Molecule: Synthetic oligonucleotide
gacuccuccuaccaacuggtt

SEQ ID NO: 2423 - DNA, 21 bp, Artificial Sequence
  Description of Artificial Sequence: Synthetic oligonucleotide
  Description of Combined DNA/RNA Molecule: Synthetic oligonucleotide
guguuacugggacuccucctt

SEQ ID NO: 2424 - DNA, 21 bp, Artificial Sequence
  Description of Artificial Sequence: Synthetic oligonucleotide
  Description of Combined DNA/RNA Molecule: Synthetic oligonucleotide
ugugcauucaguguuacugtt

SEQ ID NO: 2425 - DNA, 21 bp, Artificial Sequence
  Description of Artificial Sequence: Synthetic oligonucleotide
  Description of Combined DNA/RNA Molecule: Synthetic oligonucleotide
aucaauuguuugugcauuctt

SEQ ID NO: 2426 - DNA, 21 bp, Artificial Sequence
  Description of Artificial Sequence: Synthetic oligonucleotide
  Description of Combined DNA/RNA Molecule: Synthetic oligonucleotide
uugguuuacaucaauuguutt

SEQ ID NO: 2427 - DNA, 21 bp, Artificial Sequence
  Description of Artificial Sequence: Synthetic oligonucleotide
  Description of Combined DNA/RNA Molecule: Synthetic oligonucleotide
ucagaugucucuugguuuatt

SEQ ID NO: 2428 - DNA, 21 bp, Artificial Sequence
  Description of Artificial Sequence: Synthetic oligonucleotide
  Description of Combined DNA/RNA Molecule: Synthetic oligonucleotide
cuuggauccaagucagaugtt

SEQ ID NO: 2429 - DNA, 21 bp, Artificial Sequence
  Description of Artificial Sequence: Synthetic oligonucleotide
  Description of Combined DNA/RNA Molecule: Synthetic oligonucleotide
uuacacuuuugcuuggauctt

SEQ ID NO: 2430 - DNA, 21 bp, Artificial Sequence
  Description of Artificial Sequence: Synthetic oligonucleotide
  Description of Combined DNA/RNA Molecule: Synthetic oligonucleotide
aacacguguuacacuuuugtt

SEQ ID NO: 2431 - DNA, 21 bp, Artificial Sequence
  Description of Artificial Sequence: Synthetic oligonucleotide
  Description of Combined DNA/RNA Molecule: Synthetic oligonucleotide
uccaucaucaacacguguutt

SEQ ID NO: 2432 - DNA, 21 bp, Artificial Sequence
  Description of Artificial Sequence: Synthetic oligonucleotide
  Description of Combined DNA/RNA Molecule: Synthetic oligonucleotide
aaaggaagcuacuccaucatt

SEQ ID NO: 2433 - DNA, 21 bp, Artificial Sequence
  Description of Artificial Sequence: Synthetic oligonucleotide
  Description of Combined DNA/RNA Molecule: Synthetic oligonucleotide
uaagcacaaaggaagcuactt

SEQ ID NO: 2434 - DNA, 21 bp, Artificial Sequence
  Description of Artificial Sequence: Synthetic oligonucleotide
  Description of Combined DNA/RNA Molecule: Synthetic oligonucleotide
uccagaugggagauuaagctt

SEQ ID NO: 2435 - DNA, 21 bp, Artificial Sequence
  Description of Artificial Sequence: Synthetic oligonucleotide
  Description of Combined DNA/RNA Molecule: Synthetic oligonucleotide
gcaccgucacuccagauggtt

SEQ ID NO: 2436 - DNA, 21 bp, Artificial Sequence
  Description of Artificial Sequence: Synthetic oligonucleotide
  Description of Combined DNA/RNA Molecule: Synthetic oligonucleotide
uuaaacuccagcaccgucatt

SEQ ID NO: 2437 - DNA, 21 bp, Artificial Sequence
  Description of Artificial Sequence: Synthetic oligonucleotide
  Description of Combined DNA/RNA Molecule: Synthetic oligonucleotide
uuugacauuaaacuccagctt

SEQ ID NO: 2438 - DNA, 21 bp, Artificial Sequence
  Description of Artificial Sequence: Synthetic oligonucleotide
  Description of Combined DNA/RNA Molecule: Synthetic oligonucleotide
uggagcaucaguuuugacatt

SEQ ID NO: 2439 - DNA, 21 bp, Artificial Sequence
  Description of Artificial Sequence: Synthetic oligonucleotide
  Description of Combined DNA/RNA Molecule: Synthetic oligonucleotide
cuggaagaucuggagcauctt

SEQ ID NO: 2440 - DNA, 21 bp, Artificial Sequence
  Description of Artificial Sequence: Synthetic oligonucleotide
  Description of Combined DNA/RNA Molecule: Synthetic oligonucleotide
uuuucuucuggaagaucugtt

SEQ ID NO: 2441 - DNA, 21 bp, Artificial Sequence
  Description of Artificial Sequence: Synthetic oligonucleotide
  Description of Combined DNA/RNA Molecule: Synthetic oligonucleotide
uucccuggccugauuuucutt

SEQ ID NO: 2442 - DNA, 21 bp, Artificial Sequence
  Description of Artificial Sequence: Synthetic oligonucleotide
  Description of Combined DNA/RNA Molecule: Synthetic oligonucleotide
ucgguaaccuucccuggcctt

SEQ ID NO: 2443 - DNA, 21 bp, Artificial Sequence
  Description of Artificial Sequence: Synthetic oligonucleotide
  Description of Combined DNA/RNA Molecule: Synthetic oligonucleotide
uaugcuauugcucgguaactt

SEQ ID NO: 2444 - DNA, 21 bp, Artificial Sequence
  Description of Artificial Sequence: Synthetic oligonucleotide
  Description of Combined DNA/RNA Molecule: Synthetic oligonucleotide
ugagagaugaguaugcuautt

SEQ ID NO: 2445 - DNA, 21 bp, Artificial Sequence
  Description of Artificial Sequence: Synthetic oligonucleotide
  Description of Combined DNA/RNA Molecule: Synthetic oligonucleotide
uuuggcugagagaugaguatt

SEQ ID NO: 2446 - DNA, 21 bp, Artificial Sequence
  Description of Artificial Sequence: Synthetic oligonucleotide
  Description of Combined DNA/RNA Molecule: Synthetic oligonucleotide
auauaaagguaacuuuggctt

SEQ ID NO: 2447 - DNA, 21 bp, Artificial Sequence
  Description of Artificial Sequence: Synthetic oligonucleotide
  Description of Combined DNA/RNA Molecule: Synthetic oligonucleotide
aguccaaucaauauaaaggtt

SEQ ID NO: 2448 - DNA, 21 bp, Artificial Sequence
  Description of Artificial Sequence: Synthetic oligonucleotide
  Description of Combined DNA/RNA Molecule: Synthetic oligonucleotide
uaugguuaucaguccaauctt

SEQ ID NO: 2449 - DNA, 21 bp, Artificial Sequence
  Description of Artificial Sequence: Synthetic oligonucleotide
  Description of Combined DNA/RNA Molecule: Synthetic oligonucleotide
aaagccuuaugguuaucagtt

SEQ ID NO: 2450 - DNA, 21 bp, Artificial Sequence
  Description of Artificial Sequence: Synthetic oligonucleotide
  Description of Combined DNA/RNA Molecule: Synthetic oligonucleotide
ucucccacuagcaaagccutt

SEQ ID NO: 2451 - DNA, 21 bp, Artificial Sequence
  Description of Artificial Sequence: Synthetic oligonucleotide
  Description of Combined DNA/RNA Molecule: Synthetic oligonucleotide
uauucagauguucucccactt

SEQ ID NO: 2452 - DNA, 21 bp, Artificial Sequence
  Description of Artificial Sequence: Synthetic oligonucleotide
  Description of Combined DNA/RNA Molecule: Synthetic oligonucleotide
uaacaauaauauucagaugtt

SEQ ID NO: 2453 - DNA, 21 bp, Artificial Sequence
  Description of Artificial Sequence: Synthetic oligonucleotide
  Description of Combined DNA/RNA Molecule: Synthetic oligonucleotide
uuuggggguaacaauaauatt

SEQ ID NO: 2454 - DNA, 21 bp, Artificial Sequence
  Description of Artificial Sequence: Synthetic oligonucleotide
  Description of Combined DNA/RNA Molecule: Synthetic oligonucleotide
caauauaugggcuuuugggtt

SEQ ID NO: 2455 - DNA, 21 bp, Artificial Sequence
  Description of Artificial Sequence: Synthetic oligonucleotide
  Description of Combined DNA/RNA Molecule: Synthetic oligonucleotide
ucaauauaugggcuuuuggtt

SEQ ID NO: 2456 - DNA, 21 bp, Artificial Sequence
  Description of Artificial Sequence: Synthetic oligonucleotide
  Description of Combined DNA/RNA Molecule: Synthetic oligonucleotide
gucaauauaugggcuuuugtt

SEQ ID NO: 2457 - DNA, 21 bp, Artificial Sequence
  Description of Artificial Sequence: Synthetic oligonucleotide
  Description of Combined DNA/RNA Molecule: Synthetic oligonucleotide
ugucaauauaugggcuuuutt

SEQ ID NO: 2458 - DNA, 21 bp, Artificial Sequence
  Description of Artificial Sequence: Synthetic oligonucleotide
  Description of Combined DNA/RNA Molecule: Synthetic oligonucleotide
uugucaauauaugggcuuutt

SEQ ID NO: 2459 - DNA, 21 bp, Artificial Sequence
  Description of Artificial Sequence: Synthetic oligonucleotide
  Description of Combined DNA/RNA Molecule: Synthetic oligonucleotide
uuugucaauauaugggcuutt

SEQ ID NO: 2460 - DNA, 21 bp, Artificial Sequence
  Description of Artificial Sequence: Synthetic oligonucleotide
  Description of Combined DNA/RNA Molecule: Synthetic oligonucleotide
uuuugucaauauaugggcutt

SEQ ID NO: 2461 - DNA, 21 bp, Artificial Sequence
  Description of Artificial Sequence: Synthetic oligonucleotide
  Description of Combined DNA/RNA Molecule: Synthetic oligonucleotide
auuuugucaauauaugggctt

SEQ ID NO: 2462 - DNA, 21 bp, Artificial Sequence
  Description of Artificial Sequence: Synthetic oligonucleotide
  Description of Combined DNA/RNA Molecule: Synthetic oligonucleotide
uauuuugucaauauaugggtt

SEQ ID NO: 2463 - DNA, 21 bp, Artificial Sequence
  Description of Artificial Sequence: Synthetic oligonucleotide
  Description of Combined DNA/RNA Molecule: Synthetic oligonucleotide
uuauuuugucaauauauggtt

SEQ ID NO: 2464 - DNA, 21 bp, Artificial Sequence
  Description of Artificial Sequence: Synthetic oligonucleotide
  Description of Combined DNA/RNA Molecule: Synthetic oligonucleotide
guuauuuugucaauauaugtt

SEQ ID NO: 2465 - DNA, 21 bp, Artificial Sequence
  Description of Artificial Sequence: Synthetic oligonucleotide
  Description of Combined DNA/RNA Molecule: Synthetic oligonucleotide
aguuauuuugucaauauautt

SEQ ID NO: 2466 - DNA, 21 bp, Artificial Sequence
  Description of Artificial Sequence: Synthetic oligonucleotide
  Description of Combined DNA/RNA Molecule: Synthetic oligonucleotide
gaguuauuuugucaauauatt

SEQ ID NO: 2467 - DNA, 21 bp, Artificial Sequence
  Description of Artificial Sequence: Synthetic oligonucleotide
  Description of Combined DNA/RNA Molecule: Synthetic oligonucleotide
ugaguuauuuugucaauautt

SEQ ID NO: 2468 - DNA, 21 bp, Artificial Sequence
  Description of Artificial Sequence: Synthetic oligonucleotide
  Description of Combined DNA/RNA Molecule: Synthetic oligonucleotide
gugaguuauuuugucaauatt

SEQ ID NO: 2469 - DNA, 21 bp, Artificial Sequence
  Description of Artificial Sequence: Synthetic oligonucleotide
  Description of Combined DNA/RNA Molecule: Synthetic oligonucleotide
agugaguuauuuugucaautt

SEQ ID NO: 2470 - DNA, 21 bp, Artificial Sequence
  Description of Artificial Sequence: Synthetic oligonucleotide
  Description of Combined DNA/RNA Molecule: Synthetic oligonucleotide
uagugaguuauuuugucaatt

SEQ ID NO: 2471 - DNA, 21 bp, Artificial Sequence
  Description of Artificial Sequence: Synthetic oligonucleotide
  Description of Combined DNA/RNA Molecule: Synthetic oligonucleotide
auagugaguuauuuugucatt

SEQ ID NO: 2472 - DNA, 21 bp, Artificial Sequence
  Description of Artificial Sequence: Synthetic oligonucleotide
  Description of Combined DNA/RNA Molecule: Synthetic oligonucleotide
uauagugaguuauuuuguctt

SEQ ID NO: 2473 - DNA, 21 bp, Artificial Sequence
  Description of Artificial Sequence: Synthetic oligonucleotide
  Description of Combined DNA/RNA Molecule: Synthetic oligonucleotide
aauuauagugaguuauuuutt

SEQ ID NO: 2474 - DNA, 21 bp, Artificial Sequence
  Description of Artificial Sequence: Synthetic oligonucleotide
  Description of Combined DNA/RNA Molecule: Synthetic oligonucleotide
uaauuauagugaguuauuutt

SEQ ID NO: 2475 - DNA, 21 bp, Artificial Sequence
  Description of Artificial Sequence: Synthetic oligonucleotide
  Description of Combined DNA/RNA Molecule: Synthetic oligonucleotide
guaauuauagugaguuauutt

SEQ ID NO: 2476 - DNA, 21 bp, Artificial Sequence
  Description of Artificial Sequence: Synthetic oligonucleotide
  Description of Combined DNA/RNA Molecule: Synthetic oligonucleotide
aguaauuauagugaguuautt

SEQ ID NO: 2477 - DNA, 21 bp, Artificial Sequence
  Description of Artificial Sequence: Synthetic oligonucleotide
  Description of Combined DNA/RNA Molecule: Synthetic oligonucleotide
caaguaauuauagugaguutt

SEQ ID NO: 2478 - DNA, 21 bp, Artificial Sequence
  Description of Artificial Sequence: Synthetic oligonucleotide
  Description of Combined DNA/RNA Molecule: Synthetic oligonucleotide
ucaaguaauuauagugagutt

SEQ ID NO: 2479 - DNA, 21 bp, Artificial Sequence
  Description of Artificial Sequence: Synthetic oligonucleotide
  Description of Combined DNA/RNA Molecule: Synthetic oligonucleotide
aucaaguaauuauagugagtt

SEQ ID NO: 2480 - DNA, 21 bp, Artificial Sequence
  Description of Artificial Sequence: Synthetic oligonucleotide
  Description of Combined DNA/RNA Molecule: Synthetic oligonucleotide
aaucaaguaauuauagugatt

SEQ ID NO: 2481 - DNA, 21 bp, Artificial Sequence
  Description of Artificial Sequence: Synthetic oligonucleotide
  Description of Combined DNA/RNA Molecule: Synthetic oligonucleotide
aaaaucaaguaauuauagutt

SEQ ID NO: 2482 - DNA, 21 bp, Artificial Sequence
  Description of Artificial Sequence: Synthetic oligonucleotide
  Description of Combined DNA/RNA Molecule: Synthetic oligonucleotide
uaaaaucaaguaauuauagtt

SEQ ID NO: 2483 - DNA, 21 bp, Artificial Sequence
  Description of Artificial Sequence: Synthetic oligonucleotide
  Description of Combined DNA/RNA Molecule: Synthetic oligonucleotide
auaaaaucaaguaauuauatt

SEQ ID NO: 2484 - DNA, 21 bp, Artificial Sequence
  Description of Artificial Sequence: Synthetic oligonucleotide
  Description of Combined DNA/RNA Molecule: Synthetic oligonucleotide
gauaaaaucaaguaauuautt

SEQ ID NO: 2485 - DNA, 21 bp, Artificial Sequence
  Description of Artificial Sequence: Synthetic oligonucleotide
  Description of Combined DNA/RNA Molecule: Synthetic oligonucleotide
ggauaaaaucaaguaauuatt

SEQ ID NO: 2486 - DNA, 21 bp, Artificial Sequence
  Description of Artificial Sequence: Synthetic oligonucleotide
  Description of Combined DNA/RNA Molecule: Synthetic oligonucleotide
uggauaaaaucaaguaauutt

SEQ ID NO: 2487 - DNA, 21 bp, Artificial Sequence
  Description of Artificial Sequence: Synthetic oligonucleotide
  Description of Combined DNA/RNA Molecule: Synthetic oligonucleotide
uuggauaaaaucaaguaautt

SEQ ID NO: 2488 - DNA, 21 bp, Artificial Sequence
  Description of Artificial Sequence: Synthetic oligonucleotide
  Description of Combined DNA/RNA Molecule: Synthetic oligonucleotide
uaauuuugcccuuggauaatt

SEQ ID NO: 2489 - DNA, 21 bp, Artificial Sequence
  Description of Artificial Sequence: Synthetic oligonucleotide
  Description of Combined DNA/RNA Molecule: Synthetic oligonucleotide
ccaaaguggauaauuuugctt

SEQ ID NO: 2490 - DNA, 21 bp, Artificial Sequence
  Description of Artificial Sequence: Synthetic oligonucleotide
  Description of Combined DNA/RNA Molecule: Synthetic oligonucleotide
ucucccucgugccaaagugtt

SEQ ID NO: 2491 - DNA, 21 bp, Artificial Sequence
  Description of Artificial Sequence: Synthetic oligonucleotide
  Description of Combined DNA/RNA Molecule: Synthetic oligonucleotide
ucugaaaauuucucccucgtt

SEQ ID NO: 2492 - DNA, 21 bp, Artificial Sequence
  Description of Artificial Sequence: Synthetic oligonucleotide
  Description of Combined DNA/RNA Molecule: Synthetic oligonucleotide
auaagaugcaucugaaaautt

SEQ ID NO: 2493 - DNA, 21 bp, Artificial Sequence
  Description of Artificial Sequence: Synthetic oligonucleotide
  Description of Combined DNA/RNA Molecule: Synthetic oligonucleotide
uuauacuuugauaagaugctt

SEQ ID NO: 2494 - DNA, 21 bp, Artificial Sequence
  Description of Artificial Sequence: Synthetic oligonucleotide
  Description of Combined DNA/RNA Molecule: Synthetic oligonucleotide
cuggaauguuuauacuuugtt

SEQ ID NO: 2495 - DNA, 21 bp, Artificial Sequence
  Description of Artificial Sequence: Synthetic oligonucleotide
  Description of Combined DNA/RNA Molecule: Synthetic oligonucleotide
uguucuguguuacuggaautt

SEQ ID NO: 2496 - DNA, 21 bp, Artificial Sequence
  Description of Artificial Sequence: Synthetic oligonucleotide
  Description of Combined DNA/RNA Molecule: Synthetic oligonucleotide
gaaggaaccauguucugugtt

SEQ ID NO: 2497 - DNA, 21 bp, Artificial Sequence
  Description of Artificial Sequence: Synthetic oligonucleotide
  Description of Combined DNA/RNA Molecule: Synthetic oligonucleotide
aagucgggaugaaggaacctt

SEQ ID NO: 2498 - DNA, 21 bp, Artificial Sequence
  Description of Artificial Sequence: Synthetic oligonucleotide
  Description of Combined DNA/RNA Molecule: Synthetic oligonucleotide
uaauagaccagaagucgggtt

SEQ ID NO: 2499 - DNA, 21 bp, Artificial Sequence
  Description of Artificial Sequence: Synthetic oligonucleotide
  Description of Combined DNA/RNA Molecule: Synthetic oligonucleotide
ugugacgauguaauagacctt

SEQ ID NO: 2500 - DNA, 21 bp, Artificial Sequence
  Description of Artificial Sequence: Synthetic oligonucleotide
  Description of Combined DNA/RNA Molecule: Synthetic oligonucleotide
ucuguucuccugugacgautt

SEQ ID NO: 2501 - DNA, 21 bp, Artificial Sequence
  Description of Artificial Sequence: Synthetic oligonucleotide
  Description of Combined DNA/RNA Molecule: Synthetic oligonucleotide
ucugcugucuguucuccugtt

SEQ ID NO: 2502 - DNA, 21 bp, Artificial Sequence
  Description of Artificial Sequence: Synthetic oligonucleotide
  Description of Combined DNA/RNA Molecule: Synthetic oligonucleotide
ucagacacuaauucugcugtt

SEQ ID NO: 2503 - DNA, 21 bp, Artificial Sequence
  Description of Artificial Sequence: Synthetic oligonucleotide
  Description of Combined DNA/RNA Molecule: Synthetic oligonucleotide
accagacugaaucagacactt

SEQ ID NO: 2504 - DNA, 21 bp, Artificial Sequence
  Description of Artificial Sequence: Synthetic oligonucleotide
  Description of Combined DNA/RNA Molecule: Synthetic oligonucleotide
ucaauauuuaaccagacugtt

SEQ ID NO: 2505 - DNA, 21 bp, Artificial Sequence
  Description of Artificial Sequence: Synthetic oligonucleotide
  Description of Combined DNA/RNA Molecule: Synthetic oligonucleotide
uuuuucuucaauauuuaactt

SEQ ID NO: 2506 - DNA, 21 bp, Artificial Sequence
  Description of Artificial Sequence: Synthetic oligonucleotide
  Description of Combined DNA/RNA Molecule: Synthetic oligonucleotide
cugguugccacauuuuucutt

SEQ ID NO: 2507 - DNA, 21 bp, Artificial Sequence
  Description of Artificial Sequence: Synthetic oligonucleotide
  Description of Combined DNA/RNA Molecule: Synthetic oligonucleotide
ugaaccuggagcugguugctt

SEQ ID NO: 2508 - DNA, 21 bp, Artificial Sequence
  Description of Artificial Sequence: Synthetic oligonucleotide
  Description of Combined DNA/RNA Molecule: Synthetic oligonucleotide
agacagaugaaccuggagctt

SEQ ID NO: 2509 - DNA, 21 bp, Artificial Sequence
  Description of Artificial Sequence: Synthetic oligonucleotide
  Description of Combined DNA/RNA Molecule: Synthetic oligonucleotide
ucugcaucaggagacagautt

SEQ ID NO: 2510 - DNA, 21 bp, Artificial Sequence
  Description of Artificial Sequence: Synthetic oligonucleotide
  Description of Combined DNA/RNA Molecule: Synthetic oligonucleotide
gagaauaugcaucugcauctt

SEQ ID NO: 2511 - DNA, 21 bp, Artificial Sequence
  Description of Artificial Sequence: Synthetic oligonucleotide
  Description of Combined DNA/RNA Molecule: Synthetic oligonucleotide
uuuggccuggagaauaugctt

SEQ ID NO: 2512 - DNA, 21 bp, Artificial Sequence
  Description of Artificial Sequence: Synthetic oligonucleotide
  Description of Combined DNA/RNA Molecule: Synthetic oligonucleotide
aagagacacaguuuggccutt

SEQ ID NO: 2513 - DNA, 21 bp, Artificial Sequence
  Description of Artificial Sequence: Synthetic oligonucleotide
  Description of Combined DNA/RNA Molecule: Synthetic oligonucleotide
uugccauauuaagagacactt

SEQ ID NO: 2514 - DNA, 21 bp, Artificial Sequence
  Description of Artificial Sequence: Synthetic oligonucleotide
  Description of Combined DNA/RNA Molecule: Synthetic oligonucleotide
auuccaguugccauauuaatt

SEQ ID NO: 2515 - DNA, 21 bp, Artificial Sequence
  Description of Artificial Sequence: Synthetic oligonucleotide
  Description of Combined DNA/RNA Molecule: Synthetic oligonucleotide
ccaggaauccauuccaguutt

SEQ ID NO: 2516 - DNA, 21 bp, Artificial Sequence
  Description of Artificial Sequence: Synthetic oligonucleotide
  Description of Combined DNA/RNA Molecule: Synthetic oligonucleotide
ugcuaaugccacccaggaatt

SEQ ID NO: 2517 - DNA, 21 bp, Artificial Sequence
  Description of Artificial Sequence: Synthetic oligonucleotide
  Description of Combined DNA/RNA Molecule: Synthetic oligonucleotide
guccacugcugcuaaugcctt

SEQ ID NO: 2518 - DNA, 21 bp, Artificial Sequence
  Description of Artificial Sequence: Synthetic oligonucleotide
  Description of Combined DNA/RNA Molecule: Synthetic oligonucleotide
auacacagcacuguccacutt

SEQ ID NO: 2519 - DNA, 21 bp, Artificial Sequence
  Description of Artificial Sequence: Synthetic oligonucleotide
  Description of Combined DNA/RNA Molecule: Synthetic oligonucleotide
uuuggacuccauacacagctt

SEQ ID NO: 2520 - DNA, 21 bp, Artificial Sequence
  Description of Artificial Sequence: Synthetic oligonucleotide
  Description of Combined DNA/RNA Molecule: Synthetic oligonucleotide
uuuggcuccucuuuggacutt

SEQ ID NO: 2521 - DNA, 21 bp, Artificial Sequence
  Description of Artificial Sequence: Synthetic oligonucleotide
  Description of Combined DNA/RNA Molecule: Synthetic oligonucleotide
agggcuuuuuggcuccucutt

SEQ ID NO: 2522 - DNA, 21 bp, Artificial Sequence
  Description of Artificial Sequence: Synthetic oligonucleotide
  Description of Combined DNA/RNA Molecule: Synthetic oligonucleotide
aauacucuuuccaagggcutt

SEQ ID NO: 2523 - DNA, 21 bp, Artificial Sequence
  Description of Artificial Sequence: Synthetic oligonucleotide
  Description of Combined DNA/RNA Molecule: Synthetic oligonucleotide
uaagaauugaaauacucuutt

SEQ ID NO: 2524 - DNA, 21 bp, Artificial Sequence
  Description of Artificial Sequence: Synthetic oligonucleotide
  Description of Combined DNA/RNA Molecule: Synthetic oligonucleotide
ucuucucuaagaauugaaatt

SEQ ID NO: 2525 - DNA, 21 bp, Artificial Sequence
  Description of Artificial Sequence: Synthetic oligonucleotide
  Description of Combined DNA/RNA Molecule: Synthetic oligonucleotide
agcccagaucacucuucuctt

SEQ ID NO: 2526 - DNA, 21 bp, Artificial Sequence
  Description of Artificial Sequence: Synthetic oligonucleotide
  Description of Combined DNA/RNA Molecule: Synthetic oligonucleotide
ugccccacagcccagaucatt

SEQ ID NO: 2527 - DNA, 21 bp, Artificial Sequence
  Description of Artificial Sequence: Synthetic oligonucleotide
  Description of Combined DNA/RNA Molecule: Synthetic oligonucleotide
ugaggccaccaccugcccctt

SEQ ID NO: 2528 - DNA, 21 bp, Artificial Sequence
  Description of Artificial Sequence: Synthetic oligonucleotide
  Description of Combined DNA/RNA Molecule: Synthetic oligonucleotide
uuggcauuguugaggccactt

SEQ ID NO: 2529 - DNA, 21 bp, Artificial Sequence
  Description of Artificial Sequence: Synthetic oligonucleotide
  Description of Combined DNA/RNA Molecule: Synthetic oligonucleotide
gaacacauuggcauuguugtt

SEQ ID NO: 2530 - DNA, 21 bp, Artificial Sequence
  Description of Artificial Sequence: Synthetic oligonucleotide
  Description of Combined DNA/RNA Molecule: Synthetic oligonucleotide
agcuagguggaacacauugtt

SEQ ID NO: 2531 - DNA, 21 bp, Artificial Sequence
  Description of Artificial Sequence: Synthetic oligonucleotide
  Description of Combined DNA/RNA Molecule: Synthetic oligonucleotide
agguaaguccagcuaggugtt

SEQ ID NO: 2532 - DNA, 21 bp, Artificial Sequence
  Description of Artificial Sequence: Synthetic oligonucleotide
  Description of Combined DNA/RNA Molecule: Synthetic oligonucleotide
uuagugaggaagguaaguctt

SEQ ID NO: 2533 - DNA, 21 bp, Artificial Sequence
  Description of Artificial Sequence: Synthetic oligonucleotide
  Description of Combined DNA/RNA Molecule: Synthetic oligonucleotide
ucugcauuugcauuagugatt

SEQ ID NO: 2534 - DNA, 21 bp, Artificial Sequence
  Description of Artificial Sequence: Synthetic oligonucleotide
  Description of Combined DNA/RNA Molecule: Synthetic oligonucleotide
uugggagucaucugcauuutt

SEQ ID NO: 2535 - DNA, 21 bp, Artificial Sequence
  Description of Artificial Sequence: Synthetic oligonucleotide
  Description of Combined DNA/RNA Molecule: Synthetic oligonucleotide
uucaucauuuucuugggagtt

SEQ ID NO: 2536 - DNA, 21 bp, Artificial Sequence
  Description of Artificial Sequence: Synthetic oligonucleotide
  Description of Combined DNA/RNA Molecule: Synthetic oligonucleotide
ugagaauuucuuuacaaggtt

SEQ ID NO: 2537 - DNA, 21 bp, Artificial Sequence
  Description of Artificial Sequence: Synthetic oligonucleotide
  Description of Combined DNA/RNA Molecule: Synthetic oligonucleotide
ucuucuuggccugagaauutt

SEQ ID NO: 2538 - DNA, 21 bp, Artificial Sequence
  Description of Artificial Sequence: Synthetic oligonucleotide
  Description of Combined DNA/RNA Molecule: Synthetic oligonucleotide
uuugcagcguucuucuuggtt

SEQ ID NO: 2539 - DNA, 21 bp, Artificial Sequence
  Description of Artificial Sequence: Synthetic oligonucleotide
  Description of Combined DNA/RNA Molecule: Synthetic oligonucleotide
ucuaucuucuuuugcagcgtt

SEQ ID NO: 2540 - DNA, 21 bp, Artificial Sequence
  Description of Artificial Sequence: Synthetic oligonucleotide
  Description of Combined DNA/RNA Molecule: Synthetic oligonucleotide
uauuucuucuaucuucuuutt

SEQ ID NO: 2541 - DNA, 21 bp, Artificial Sequence
  Description of Artificial Sequence: Synthetic oligonucleotide
  Description of Combined DNA/RNA Molecule: Synthetic oligonucleotide
auauuuagcagcuauuucutt

SEQ ID NO: 2542 - DNA, 21 bp, Artificial Sequence
  Description of Artificial Sequence: Synthetic oligonucleotide
  Description of Combined DNA/RNA Molecule: Synthetic oligonucleotide
aauguuuauauuuagcagctt

SEQ ID NO: 2543 - DNA, 21 bp, Artificial Sequence
  Description of Artificial Sequence: Synthetic oligonucleotide
  Description of Combined DNA/RNA Molecule: Synthetic oligonucleotide
uuucuucacuacugaaugutt

SEQ ID NO: 2544 - DNA, 21 bp, Artificial Sequence
  Description of Artificial Sequence: Synthetic oligonucleotide
  Description of Combined DNA/RNA Molecule: Synthetic oligonucleotide
aacaacauuucuucacuactt

SEQ ID NO: 2545 - DNA, 21 bp, Artificial Sequence
  Description of Artificial Sequence: Synthetic oligonucleotide
  Description of Combined DNA/RNA Molecule: Synthetic oligonucleotide
cuccaucguaacaacauuutt

SEQ ID NO: 2546 - DNA, 21 bp, Artificial Sequence
  Description of Artificial Sequence: Synthetic oligonucleotide
  Description of Combined DNA/RNA Molecule: Synthetic oligonucleotide
auuaacgcaggcuccaucgtt

SEQ ID NO: 2547 - DNA, 21 bp, Artificial Sequence
  Description of Artificial Sequence: Synthetic oligonucleotide
  Description of Combined DNA/RNA Molecule: Synthetic oligonucleotide
gguuucaucauuauuaacgtt

SEQ ID NO: 2548 - DNA, 21 bp, Artificial Sequence
  Description of Artificial Sequence: Synthetic oligonucleotide
  Description of Combined DNA/RNA Molecule: Synthetic oligonucleotide
ugcucacagguuucaucautt

SEQ ID NO: 2549 - DNA, 21 bp, Artificial Sequence
  Description of Artificial Sequence: Synthetic oligonucleotide
  Description of Combined DNA/RNA Molecule: Synthetic oligonucleotide
ugcagcucgcugcucacagtt

SEQ ID NO: 2550 - DNA, 21 bp, Artificial Sequence
  Description of Artificial Sequence: Synthetic oligonucleotide
  Description of Combined DNA/RNA Molecule: Synthetic oligonucleotide
aacuaauccgugcagcucgtt

SEQ ID NO: 2551 - DNA, 21 bp, Artificial Sequence
  Description of Artificial Sequence: Synthetic oligonucleotide
  Description of Combined DNA/RNA Molecule: Synthetic oligonucleotide
cuuggcccuaaacuaaucctt

SEQ ID NO: 2552 - DNA, 21 bp, Artificial Sequence
  Description of Artificial Sequence: Synthetic oligonucleotide
  Description of Combined DNA/RNA Molecule: Synthetic oligonucleotide
cuuugaugcaucuuggccctt

SEQ ID NO: 2553 - DNA, 21 bp, Artificial Sequence
  Description of Artificial Sequence: Synthetic oligonucleotide
  Description of Combined DNA/RNA Molecule: Synthetic oligonucleotide
uucagugaaagcuuugaugtt

SEQ ID NO: 2554 - DNA, 21 bp, Artificial Sequence
  Description of Artificial Sequence: Synthetic oligonucleotide
  Description of Combined DNA/RNA Molecule: Synthetic oligonucleotide
cacaacauucagugaaagctt

SEQ ID NO: 2555 - DNA, 21 bp, Artificial Sequence
  Description of Artificial Sequence: Synthetic oligonucleotide
  Description of Combined DNA/RNA Molecule: Synthetic oligonucleotide
cuugcgacgacacaacauutt

SEQ ID NO: 2556 - DNA, 21 bp, Artificial Sequence
  Description of Artificial Sequence: Synthetic oligonucleotide
  Description of Combined DNA/RNA Molecule: Synthetic oligonucleotide
acggagcuggcuugcgacgtt

SEQ ID NO: 2557 - DNA, 21 bp, Artificial Sequence
  Description of Artificial Sequence: Synthetic oligonucleotide
  Description of Combined DNA/RNA Molecule: Synthetic oligonucleotide
agagauauuagcacggagctt

SEQ ID NO: 2558 - DNA, 21 bp, Artificial Sequence
  Description of Artificial Sequence: Synthetic oligonucleotide
  Description of Combined DNA/RNA Molecule: Synthetic oligonucleotide
ucuuuaugagagauauuagtt

SEQ ID NO: 2559 - DNA, 21 bp, Artificial Sequence
  Description of Artificial Sequence: Synthetic oligonucleotide
  Description of Combined DNA/RNA Molecule: Synthetic oligonucleotide
uucccaauugcaugucuuutt

SEQ ID NO: 2560 - DNA, 21 bp, Artificial Sequence
  Description of Artificial Sequence: Synthetic oligonucleotide
  Description of Combined DNA/RNA Molecule: Synthetic oligonucleotide
uguguagccuucccaauugtt

SEQ ID NO: 2561 - DNA, 21 bp, Artificial Sequence
  Description of Artificial Sequence: Synthetic oligonucleotide
  Description of Combined DNA/RNA Molecule: Synthetic oligonucleotide
cagggucuucauguguagctt

SEQ ID NO: 2562 - DNA, 21 bp, Artificial Sequence
  Description of Artificial Sequence: Synthetic oligonucleotide
  Description of Combined DNA/RNA Molecule: Synthetic oligonucleotide
ugguaacagggucuucaugtt

SEQ ID NO: 2563 - DNA, 21 bp, Artificial Sequence
  Description of Artificial Sequence: Synthetic oligonucleotide
  Description of Combined DNA/RNA Molecule: Synthetic oligonucleotide
ucuggcuugcuuacugguatt

SEQ ID NO: 2564 - DNA, 21 bp, Artificial Sequence
  Description of Artificial Sequence: Synthetic oligonucleotide
  Description of Combined DNA/RNA Molecule: Synthetic oligonucleotide
uccgaauuucuggcuugcutt

SEQ ID NO: 2565 - DNA, 21 bp, Artificial Sequence
  Description of Artificial Sequence: Synthetic oligonucleotide
  Description of Combined DNA/RNA Molecule: Synthetic oligonucleotide
aaaauaacuccgaauuucutt

SEQ ID NO: 2566 - DNA, 21 bp, Artificial Sequence
  Description of Artificial Sequence: Synthetic oligonucleotide
  Description of Combined DNA/RNA Molecule: Synthetic oligonucleotide
agcuuucuggaaaauaacutt

SEQ ID NO: 2567 - DNA, 21 bp, Artificial Sequence
  Description of Artificial Sequence: Synthetic oligonucleotide
  Description of Combined DNA/RNA Molecule: Synthetic oligonucleotide
ucccacaaccagcuuucugtt

SEQ ID NO: 2568 - DNA, 21 bp, Artificial Sequence
  Description of Artificial Sequence: Synthetic oligonucleotide
  Description of Combined DNA/RNA Molecule: Synthetic oligonucleotide
aacaagaugaacuucccactt

SEQ ID NO: 2569 - DNA, 21 bp, Artificial Sequence
  Description of Artificial Sequence: Synthetic oligonucleotide
  Description of Combined DNA/RNA Molecule: Synthetic oligonucleotide
ucuucugggaacaagaugatt

SEQ ID NO: 2570 - DNA, 21 bp, Artificial Sequence
  Description of Artificial Sequence: Synthetic oligonucleotide
  Description of Combined DNA/RNA Molecule: Synthetic oligonucleotide
ugcaacuguuuucuucuggtt

SEQ ID NO: 2571 - DNA, 21 bp, Artificial Sequence
  Description of Artificial Sequence: Synthetic oligonucleotide
  Description of Combined DNA/RNA Molecule: Synthetic oligonucleotide
guagggcaaacugcaacugtt

SEQ ID NO: 2572 - DNA, 21 bp, Artificial Sequence
  Description of Artificial Sequence: Synthetic oligonucleotide
  Description of Combined DNA/RNA Molecule: Synthetic oligonucleotide
aaucagguagggcaaacugtt

SEQ ID NO: 2573 - DNA, 21 bp, Artificial Sequence
  Description of Artificial Sequence: Synthetic oligonucleotide
  Description of Combined DNA/RNA Molecule: Synthetic oligonucleotide
aggugguuagagaaucaggtt

SEQ ID NO: 2574 - DNA, 21 bp, Artificial Sequence
  Description of Artificial Sequence: Synthetic oligonucleotide
  Description of Combined DNA/RNA Molecule: Synthetic oligonucleotide
cuugaauuucccagguggutt

SEQ ID NO: 2575 - DNA, 21 bp, Artificial Sequence
  Description of Artificial Sequence: Synthetic oligonucleotide
  Description of Combined DNA/RNA Molecule: Synthetic oligonucleotide
ugccaacgccuugaauuuctt

SEQ ID NO: 2576 - DNA, 21 bp, Artificial Sequence
  Description of Artificial Sequence: Synthetic oligonucleotide
  Description of Combined DNA/RNA Molecule: Synthetic oligonucleotide
aguguuugaaaugccaacgtt

SEQ ID NO: 2577 - DNA, 21 bp, Artificial Sequence
  Description of Artificial Sequence: Synthetic oligonucleotide
  Description of Combined DNA/RNA Molecule: Synthetic oligonucleotide
uauaccaguguuugaaaugtt

SEQ ID NO: 2578 - DNA, 21 bp, Artificial Sequence
  Description of Artificial Sequence: Synthetic oligonucleotide
  Description of Combined DNA/RNA Molecule: Synthetic oligonucleotide
guaucagcaacacauauactt

SEQ ID NO: 2579 - DNA, 21 bp, Artificial Sequence
  Description of Artificial Sequence: Synthetic oligonucleotide
  Description of Combined DNA/RNA Molecule: Synthetic oligonucleotide
ugccuugacaguaucagcatt

SEQ ID NO: 2580 - DNA, 21 bp, Artificial Sequence
  Description of Artificial Sequence: Synthetic oligonucleotide
  Description of Combined DNA/RNA Molecule: Synthetic oligonucleotide
aacaccuuugccuugacagtt

SEQ ID NO: 2581 - DNA, 21 bp, Artificial Sequence
  Description of Artificial Sequence: Synthetic oligonucleotide
  Description of Combined DNA/RNA Molecule: Synthetic oligonucleotide
aagacaucuuugaacaccutt

SEQ ID NO: 2582 - DNA, 21 bp, Artificial Sequence
  Description of Artificial Sequence: Synthetic oligonucleotide
  Description of Combined DNA/RNA Molecule: Synthetic oligonucleotide
uuccaggaagacaucuuugtt

SEQ ID NO: 2583 - DNA, 21 bp, Artificial Sequence
  Description of Artificial Sequence: Synthetic oligonucleotide
  Description of Combined DNA/RNA Molecule: Synthetic oligonucleotide
uauauucauuuccaggaagtt

SEQ ID NO: 2584 - DNA, 21 bp, Artificial Sequence
  Description of Artificial Sequence: Synthetic oligonucleotide
  Description of Combined DNA/RNA Molecule: Synthetic oligonucleotide
aacagaauaugguauauuctt

SEQ ID NO: 2585 - DNA, 21 bp, Artificial Sequence
  Description of Artificial Sequence: Synthetic oligonucleotide
  Description of Combined DNA/RNA Molecule: Synthetic oligonucleotide
uccucguacaacagaauautt

SEQ ID NO: 2586 - DNA, 21 bp, Artificial Sequence
  Description of Artificial Sequence: Synthetic oligonucleotide
  Description of Combined DNA/RNA Molecule: Synthetic oligonucleotide
auuggaucuguucuccucgtt

SEQ ID NO: 2587 - DNA, 21 bp, Artificial Sequence
  Description of Artificial Sequence: Synthetic oligonucleotide
  Description of Combined DNA/RNA Molecule: Synthetic oligonucleotide
cuuucaauuggaucuguuctt

SEQ ID NO: 2588 - DNA, 21 bp, Artificial Sequence
  Description of Artificial Sequence: Synthetic oligonucleotide
  Description of Combined DNA/RNA Molecule: Synthetic oligonucleotide
guuguaaacaguuccuuuctt

SEQ ID NO: 2589 - DNA, 21 bp, Artificial Sequence
  Description of Artificial Sequence: Synthetic oligonucleotide
  Description of Combined DNA/RNA Molecule: Synthetic oligonucleotide
uccuauaguuguaaacagutt

SEQ ID NO: 2590 - DNA, 21 bp, Artificial Sequence
  Description of Artificial Sequence: Synthetic oligonucleotide
  Description of Combined DNA/RNA Molecule: Synthetic oligonucleotide
ucccagaaguccuauaguutt

SEQ ID NO: 2591 - DNA, 21 bp, Artificial Sequence
  Description of Artificial Sequence: Synthetic oligonucleotide
  Description of Combined DNA/RNA Molecule: Synthetic oligonucleotide
aacacagaacugcaucccatt

SEQ ID NO: 2592 - DNA, 21 bp, Artificial Sequence
  Description of Artificial Sequence: Synthetic oligonucleotide
  Description of Combined DNA/RNA Molecule: Synthetic oligonucleotide
agacauuuuaacacagaactt

SEQ ID NO: 2593 - DNA, 21 bp, Artificial Sequence
  Description of Artificial Sequence: Synthetic oligonucleotide
  Description of Combined DNA/RNA Molecule: Synthetic oligonucleotide
uccacagcagacauuuuaatt

SEQ ID NO: 2594 - DNA, 21 bp, Artificial Sequence
  Description of Artificial Sequence: Synthetic oligonucleotide
  Description of Combined DNA/RNA Molecule: Synthetic oligonucleotide
gugcagauucccuccacagtt

SEQ ID NO: 2595 - DNA, 21 bp, Artificial Sequence
  Description of Artificial Sequence: Synthetic oligonucleotide
  Description of Combined DNA/RNA Molecule: Synthetic oligonucleotide
uuuccgaagugcagauucctt

SEQ ID NO: 2596 - DNA, 21 bp, Artificial Sequence
  Description of Artificial Sequence: Synthetic oligonucleotide
  Description of Combined DNA/RNA Molecule: Synthetic oligonucleotide
ucaaugacugggcuuuccgtt

SEQ ID NO: 2597 - DNA, 21 bp, Artificial Sequence
  Description of Artificial Sequence: Synthetic oligonucleotide
  Description of Combined DNA/RNA Molecule: Synthetic oligonucleotide
ccugaugaucaaugacuggtt

SEQ ID NO: 2598 - DNA, 21 bp, Artificial Sequence
  Description of Artificial Sequence: Synthetic oligonucleotide
  Description of Combined DNA/RNA Molecule: Synthetic oligonucleotide
aggacuuugugcccugaugtt

SEQ ID NO: 2599 - DNA, 21 bp, Artificial Sequence
  Description of Artificial Sequence: Synthetic oligonucleotide
  Description of Combined DNA/RNA Molecule: Synthetic oligonucleotide
auuuggaggacuuugugcctt

SEQ ID NO: 2600 - DNA, 21 bp, Artificial Sequence
  Description of Artificial Sequence: Synthetic oligonucleotide
  Description of Combined DNA/RNA Molecule: Synthetic oligonucleotide
uuucuggcgcacacauuugtt

SEQ ID NO: 2601 - DNA, 21 bp, Artificial Sequence
  Description of Artificial Sequence: Synthetic oligonucleotide
  Description of Combined DNA/RNA Molecule: Synthetic oligonucleotide
gcccucuacuuucuggcgctt

SEQ ID NO: 2602 - DNA, 21 bp, Artificial Sequence
  Description of Artificial Sequence: Synthetic oligonucleotide
  Description of Combined DNA/RNA Molecule: Synthetic oligonucleotide
acuggaggagcccucuacutt

SEQ ID NO: 2603 - DNA, 21 bp, Artificial Sequence
  Description of Artificial Sequence: Synthetic oligonucleotide
  Description of Combined DNA/RNA Molecule: Synthetic oligonucleotide
gucaccaagugacuggaggtt

SEQ ID NO: 2604 - DNA, 21 bp, Artificial Sequence
  Description of Artificial Sequence: Synthetic oligonucleotide
  Description of Combined DNA/RNA Molecule: Synthetic oligonucleotide
agugaaugucaccaagugatt

SEQ ID NO: 2605 - DNA, 21 bp, Artificial Sequence
  Description of Artificial Sequence: Synthetic oligonucleotide
  Description of Combined DNA/RNA Molecule: Synthetic oligonucleotide
agaggaagcacagugaaugtt

SEQ ID NO: 2606 - DNA, 21 bp, Artificial Sequence
  Description of Artificial Sequence: Synthetic oligonucleotide
  Description of Combined DNA/RNA Molecule: Synthetic oligonucleotide
guugugaaggccaauuucctt

SEQ ID NO: 2607 - DNA, 21 bp, Artificial Sequence
  Description of Artificial Sequence: Synthetic oligonucleotide
  Description of Combined DNA/RNA Molecule: Synthetic oligonucleotide
aaaaauugauguugugaagtt

SEQ ID NO: 2608 - DNA, 21 bp, Artificial Sequence
  Description of Artificial Sequence: Synthetic oligonucleotide
  Description of Combined DNA/RNA Molecule: Synthetic oligonucleotide
aagucuccagugaaaaauutt

SEQ ID NO: 2609 - DNA, 21 bp, Artificial Sequence
  Description of Artificial Sequence: Synthetic oligonucleotide
  Description of Combined DNA/RNA Molecule: Synthetic oligonucleotide
uuccaaaccaagucuccagtt

SEQ ID NO: 2610 - DNA, 21 bp, Artificial Sequence
  Description of Artificial Sequence: Synthetic oligonucleotide
  Description of Combined DNA/RNA Molecule: Synthetic oligonucleotide
aagauuucuuuuccaaacctt

SEQ ID NO: 2611 - DNA, 21 bp, Artificial Sequence
  Description of Artificial Sequence: Synthetic oligonucleotide
  Description of Combined DNA/RNA Molecule: Synthetic oligonucleotide
uaauguuuuuacuaagauutt

SEQ ID NO: 2612 - DNA, 21 bp, Artificial Sequence
  Description of Artificial Sequence: Synthetic oligonucleotide
  Description of Combined DNA/RNA Molecule: Synthetic oligonucleotide
caccacucguaauguuuuutt

SEQ ID NO: 2613 - DNA, 21 bp, Artificial Sequence
  Description of Artificial Sequence: Synthetic oligonucleotide
  Description of Combined DNA/RNA Molecule: Synthetic oligonucleotide
acaccuucuggcaccacuctt

SEQ ID NO: 2614 - DNA, 21 bp, Artificial Sequence
  Description of Artificial Sequence: Synthetic oligonucleotide
  Description of Combined DNA/RNA Molecule: Synthetic oligonucleotide
uucccuuuugacaccuucutt

SEQ ID NO: 2615 - DNA, 21 bp, Artificial Sequence
  Description of Artificial Sequence: Synthetic oligonucleotide
  Description of Combined DNA/RNA Molecule: Synthetic oligonucleotide
auagcuuucccuuuugacatt

SEQ ID NO: 2616 - DNA, 21 bp, Artificial Sequence
  Description of Artificial Sequence: Synthetic oligonucleotide
  Description of Combined DNA/RNA Molecule: Synthetic oligonucleotide
aaaguaacaccagaauagctt

SEQ ID NO: 2617 - DNA, 21 bp, Artificial Sequence
  Description of Artificial Sequence: Synthetic oligonucleotide
  Description of Combined DNA/RNA Molecule: Synthetic oligonucleotide
cuaggauccaaaguaacactt

SEQ ID NO: 2618 - DNA, 21 bp, Artificial Sequence
  Description of Artificial Sequence: Synthetic oligonucleotide
  Description of Combined DNA/RNA Molecule: Synthetic oligonucleotide
auaaauaccccuaggaucctt

SEQ ID NO: 2619 - DNA, 21 bp, Artificial Sequence
  Description of Artificial Sequence: Synthetic oligonucleotide
  Description of Combined DNA/RNA Molecule: Synthetic oligonucleotide
uaaugguaccauaaauacctt

SEQ ID NO: 2620 - DNA, 21 bp, Artificial Sequence
  Description of Artificial Sequence: Synthetic oligonucleotide
  Description of Combined DNA/RNA Molecule: Synthetic oligonucleotide
uuucgucugcuaaugguactt

SEQ ID NO: 2621 - DNA, 21 bp, Artificial Sequence
  Description of Artificial Sequence: Synthetic oligonucleotide
  Description of Combined DNA/RNA Molecule: Synthetic oligonucleotide
ugggaacuccuuucgucugtt

SEQ ID NO: 2622 - DNA, 21 bp, Artificial Sequence
  Description of Artificial Sequence: Synthetic oligonucleotide
  Description of Combined DNA/RNA Molecule: Synthetic oligonucleotide
auccuguaugggaacuccutt

SEQ ID NO: 2623 - DNA, 21 bp, Artificial Sequence
  Description of Artificial Sequence: Synthetic oligonucleotide
  Description of Combined DNA/RNA Molecule: Synthetic oligonucleotide
ucuaaggguauccuguaugtt

SEQ ID NO: 2624 - DNA, 21 bp, Artificial Sequence
  Description of Artificial Sequence: Synthetic oligonucleotide
  Description of Combined DNA/RNA Molecule: Synthetic oligonucleotide
uuuggggaccaaaucuaagtt

SEQ ID NO: 2625 - DNA, 21 bp, Artificial Sequence
  Description of Artificial Sequence: Synthetic oligonucleotide
  Description of Combined DNA/RNA Molecule: Synthetic oligonucleotide
uugauuucuguuuuggggatt

SEQ ID NO: 2626 - DNA, 21 bp, Artificial Sequence
  Description of Artificial Sequence: Synthetic oligonucleotide
  Description of Combined DNA/RNA Molecule: Synthetic oligonucleotide
aaauccuuuugauuucugutt

SEQ ID NO: 2627 - DNA, 21 bp, Artificial Sequence
  Description of Artificial Sequence: Synthetic oligonucleotide
  Description of Combined DNA/RNA Molecule: Synthetic oligonucleotide
uuuacacucaaaauccuuutt

SEQ ID NO: 2628 - DNA, 21 bp, Artificial Sequence
  Description of Artificial Sequence: Synthetic oligonucleotide
  Description of Combined DNA/RNA Molecule: Synthetic oligonucleotide
caagcaguccuuuuacacutt

SEQ ID NO: 2629 - DNA, 21 bp, Artificial Sequence
  Description of Artificial Sequence: Synthetic oligonucleotide
  Description of Combined DNA/RNA Molecule: Synthetic oligonucleotide
ucaccuacaagcaguccuutt

SEQ ID NO: 2630 - DNA, 21 bp, Artificial Sequence
  Description of Artificial Sequence: Synthetic oligonucleotide
  Description of Combined DNA/RNA Molecule: Synthetic oligonucleotide
cagacaagaucucaccuactt

SEQ ID NO: 2631 - DNA, 21 bp, Artificial Sequence
  Description of Artificial Sequence: Synthetic oligonucleotide
  Description of Combined DNA/RNA Molecule: Synthetic oligonucleotide
uuagaacugcagacaagautt

SEQ ID NO: 2632 - DNA, 21 bp, Artificial Sequence
  Description of Artificial Sequence: Synthetic oligonucleotide
  Description of Combined DNA/RNA Molecule: Synthetic oligonucleotide
ugccuuccugacuuagaactt

SEQ ID NO: 2633 - DNA, 21 bp, Artificial Sequence
  Description of Artificial Sequence: Synthetic oligonucleotide
  Description of Combined DNA/RNA Molecule: Synthetic oligonucleotide
uuaggauauugaugccuuctt

SEQ ID NO: 2634 - DNA, 21 bp, Artificial Sequence
  Description of Artificial Sequence: Synthetic oligonucleotide
  Description of Combined DNA/RNA Molecule: Synthetic oligonucleotide
agguggguuaggauauugatt

SEQ ID NO: 2635 - DNA, 21 bp, Artificial Sequence
  Description of Artificial Sequence: Synthetic oligonucleotide
  Description of Combined DNA/RNA Molecule: Synthetic oligonucleotide
acucccuuuggggagguggtt

SEQ ID NO: 2636 - DNA, 21 bp, Artificial Sequence
  Description of Artificial Sequence: Synthetic oligonucleotide
  Description of Combined DNA/RNA Molecule: Synthetic oligonucleotide
cucugcacucccuuuggggtt

SEQ ID NO: 2637 - DNA, 21 bp, Artificial Sequence
  Description of Artificial Sequence: Synthetic oligonucleotide
  Description of Combined DNA/RNA Molecule: Synthetic oligonucleotide
aucagcuccgccucugcactt

SEQ ID NO: 2638 - DNA, 21 bp, Artificial Sequence
  Description of Artificial Sequence: Synthetic oligonucleotide
  Description of Combined DNA/RNA Molecule: Synthetic oligonucleotide
gacaacgcucaucagcucctt

SEQ ID NO: 2639 - DNA, 21 bp, Artificial Sequence
  Description of Artificial Sequence: Synthetic oligonucleotide
  Description of Combined DNA/RNA Molecule: Synthetic oligonucleotide
auagaauacugggacaacgtt

SEQ ID NO: 2640 - DNA, 21 bp, Artificial Sequence
  Description of Artificial Sequence: Synthetic oligonucleotide
  Description of Combined DNA/RNA Molecule: Synthetic oligonucleotide
gaaaaacauagaauacuggtt

SEQ ID NO: 2641 - DNA, 21 bp, Artificial Sequence
  Description of Artificial Sequence: Synthetic oligonucleotide
  Description of Combined DNA/RNA Molecule: Synthetic oligonucleotide
uuuccagguagugaaaaactt

SEQ ID NO: 2642 - DNA, 21 bp, Artificial Sequence
  Description of Artificial Sequence: Synthetic oligonucleotide
  Description of Combined DNA/RNA Molecule: Synthetic oligonucleotide
augauuuccuguuuccaggtt

SEQ ID NO: 2643 - DNA, 21 bp, Artificial Sequence
  Description of Artificial Sequence: Synthetic oligonucleotide
  Description of Combined DNA/RNA Molecule: Synthetic oligonucleotide
ucagaaugaaaaauguucctt

SEQ ID NO: 2644 - DNA, 21 bp, Artificial Sequence
  Description of Artificial Sequence: Synthetic oligonucleotide
  Description of Combined DNA/RNA Molecule: Synthetic oligonucleotide
caauuaaugggucagaaugtt

SEQ ID NO: 2645 - DNA, 21 bp, Artificial Sequence
  Description of Artificial Sequence: Synthetic oligonucleotide
  Description of Combined DNA/RNA Molecule: Synthetic oligonucleotide
ucugcuuuucaauuaauggtt

SEQ ID NO: 2646 - DNA, 21 bp, Artificial Sequence
  Description of Artificial Sequence: Synthetic oligonucleotide
  Description of Combined DNA/RNA Molecule: Synthetic oligonucleotide
uuucuucaguuucugcuuutt

SEQ ID NO: 2647 - DNA, 21 bp, Artificial Sequence
  Description of Artificial Sequence: Synthetic oligonucleotide
  Description of Combined DNA/RNA Molecule: Synthetic oligonucleotide
uuuaauuuuuucuucaguutt

SEQ ID NO: 2648 - DNA, 21 bp, Artificial Sequence
  Description of Artificial Sequence: Synthetic oligonucleotide
  Description of Combined DNA/RNA Molecule: Synthetic oligonucleotide
ucccuucuuuuaauuuuuutt

SEQ ID NO: 2649 - DNA, 21 bp, Artificial Sequence
  Description of Artificial Sequence: Synthetic oligonucleotide
  Description of Combined DNA/RNA Molecule: Synthetic oligonucleotide
cauaaugcucaacaucccutt

SEQ ID NO: 2650 - DNA, 21 bp, Artificial Sequence
  Description of Artificial Sequence: Synthetic oligonucleotide
  Description of Combined DNA/RNA Molecule: Synthetic oligonucleotide
ucuguaggacauaaugcuctt

SEQ ID NO: 2651 - DNA, 21 bp, Artificial Sequence
  Description of Artificial Sequence: Synthetic oligonucleotide
  Description of Combined DNA/RNA Molecule: Synthetic oligonucleotide
ucagcauuucuguaggacatt

SEQ ID NO: 2652 - DNA, 21 bp, Artificial Sequence
  Description of Artificial Sequence: Synthetic oligonucleotide
  Description of Combined DNA/RNA Molecule: Synthetic oligonucleotide
uguaagaguagucagcauutt

SEQ ID NO: 2653 - DNA, 21 bp, Artificial Sequence
  Description of Artificial Sequence: Synthetic oligonucleotide
  Description of Combined DNA/RNA Molecule: Synthetic oligonucleotide
uccacacacuguaagaguatt

SEQ ID NO: 2654 - DNA, 21 bp, Artificial Sequence
  Description of Artificial Sequence: Synthetic oligonucleotide
  Description of Combined DNA/RNA Molecule: Synthetic oligonucleotide
uuccacccuuccacacacutt

SEQ ID NO: 2655 - DNA, 21 bp, Artificial Sequence
  Description of Artificial Sequence: Synthetic oligonucleotide
  Description of Combined DNA/RNA Molecule: Synthetic oligonucleotide
agugcuagcacuuccaccctt

SEQ ID NO: 2656 - DNA, 21 bp, Artificial Sequence
  Description of Artificial Sequence: Synthetic oligonucleotide
  Description of Combined DNA/RNA Molecule: Synthetic oligonucleotide
cuguuaaccaagugcuagctt

SEQ ID NO: 2657 - DNA, 21 bp, Artificial Sequence
  Description of Artificial Sequence: Synthetic oligonucleotide
  Description of Combined DNA/RNA Molecule: Synthetic oligonucleotide
aaagcaaaagcuguuaacctt

SEQ ID NO: 2658 - DNA, 21 bp, Artificial Sequence
  Description of Artificial Sequence: Synthetic oligonucleotide
  Description of Combined DNA/RNA Molecule: Synthetic oligonucleotide
uccaaguacucuuaaagcatt

SEQ ID NO: 2659 - DNA, 21 bp, Artificial Sequence
  Description of Artificial Sequence: Synthetic oligonucleotide
  Description of Combined DNA/RNA Molecule: Synthetic oligonucleotide
uauuuacuuguccaaguactt

SEQ ID NO: 2660 - DNA, 21 bp, Artificial Sequence
  Description of Artificial Sequence: Synthetic oligonucleotide
  Description of Combined DNA/RNA Molecule: Synthetic oligonucleotide
cuacguauuuauuuacuugtt

SEQ ID NO: 2661 - DNA, 21 bp, Artificial Sequence
  Description of Artificial Sequence: Synthetic oligonucleotide
  Description of Combined DNA/RNA Molecule: Synthetic oligonucleotide
uucugcucuacguauuuautt

SEQ ID NO: 2662 - DNA, 21 bp, Artificial Sequence
  Description of Artificial Sequence: Synthetic oligonucleotide
  Description of Combined DNA/RNA Molecule: Synthetic oligonucleotide
uugaauuuugguucugcuctt

SEQ ID NO: 2663 - DNA, 21 bp, Artificial Sequence
  Description of Artificial Sequence: Synthetic oligonucleotide
  Description of Combined DNA/RNA Molecule: Synthetic oligonucleotide
aagaauuacaaauugaauutt

SEQ ID NO: 2664 - DNA, 21 bp, Artificial Sequence
  Description of Artificial Sequence: Synthetic oligonucleotide
  Description of Combined DNA/RNA Molecule: Synthetic oligonucleotide
agccacaauaaagaauuactt

SEQ ID NO: 2665 - DNA, 21 bp, Artificial Sequence
  Description of Artificial Sequence: Synthetic oligonucleotide
  Description of Combined DNA/RNA Molecule: Synthetic oligonucleotide
auucucaacuagccacaautt

SEQ ID NO: 2666 - DNA, 21 bp, Artificial Sequence
  Description of Artificial Sequence: Synthetic oligonucleotide
  Description of Combined DNA/RNA Molecule: Synthetic oligonucleotide
auugauaauucucaacuagtt

SEQ ID NO: 2667 - DNA, 21 bp, Artificial Sequence
  Description of Artificial Sequence: Synthetic oligonucleotide
  Description of Combined DNA/RNA Molecule: Synthetic oligonucleotide
uccauuaucuaauugauaatt

SEQ ID NO: 2668 - DNA, 21 bp, Artificial Sequence
  Description of Artificial Sequence: Synthetic oligonucleotide
  Description of Combined DNA/RNA Molecule: Synthetic oligonucleotide
uuuccuugaaagauccauutt

SEQ ID NO: 2669 - DNA, 21 bp, Artificial Sequence
  Description of Artificial Sequence: Synthetic oligonucleotide
  Description of Combined DNA/RNA Molecule: Synthetic oligonucleotide
ugugaauuuuccuugaaagtt

SEQ ID NO: 2670 - DNA, 21 bp, Artificial Sequence
  Description of Artificial Sequence: Synthetic oligonucleotide
  Description of Combined DNA/RNA Molecule: Synthetic oligonucleotide
uugguugauacugugaauutt

SEQ ID NO: 2671 - DNA, 21 bp, Artificial Sequence
  Description of Artificial Sequence: Synthetic oligonucleotide
  Description of Combined DNA/RNA Molecule: Synthetic oligonucleotide
uaauuuuauugguugauactt

SEQ ID NO: 2672 - DNA, 21 bp, Artificial Sequence
  Description of Artificial Sequence: Synthetic oligonucleotide
  Description of Combined DNA/RNA Molecule: Synthetic oligonucleotide
caagguacccuguaauuuutt

SEQ ID NO: 2673 - DNA, 21 bp, Artificial Sequence
  Description of Artificial Sequence: Synthetic oligonucleotide
  Description of Combined DNA/RNA Molecule: Synthetic oligonucleotide
ucaacaggcaagguacccutt

SEQ ID NO: 2674 - DNA, 21 bp, Artificial Sequence
  Description of Artificial Sequence: Synthetic oligonucleotide
  Description of Combined DNA/RNA Molecule: Synthetic oligonucleotide
uguucucucgggcuucaactt

SEQ ID NO: 2675 - DNA, 21 bp, Artificial Sequence
  Description of Artificial Sequence: Synthetic oligonucleotide
  Description of Combined DNA/RNA Molecule: Synthetic oligonucleotide
auauaagcuguucucucggtt

SEQ ID NO: 2676 - DNA, 21 bp, Artificial Sequence
  Description of Artificial Sequence: Synthetic oligonucleotide
  Description of Combined DNA/RNA Molecule: Synthetic oligonucleotide
aaggcuguaagauauaagctt

SEQ ID NO: 2677 - DNA, 21 bp, Artificial Sequence
  Description of Artificial Sequence: Synthetic oligonucleotide
  Description of Combined DNA/RNA Molecule: Synthetic oligonucleotide
ucacaguaaaggcuguaagtt

SEQ ID NO: 2678 - DNA, 21 bp, Artificial Sequence
  Description of Artificial Sequence: Synthetic oligonucleotide
  Description of Combined DNA/RNA Molecule: Synthetic oligonucleotide
ucgaaagccuuucuaauuctt

SEQ ID NO: 2679 - DNA, 21 bp, Artificial Sequence
  Description of Artificial Sequence: Synthetic oligonucleotide
  Description of Combined DNA/RNA Molecule: Synthetic oligonucleotide
ggggcauauaucgaaagcctt

SEQ ID NO: 2680 - DNA, 21 bp, Artificial Sequence
  Description of Artificial Sequence: Synthetic oligonucleotide
  Description of Combined DNA/RNA Molecule: Synthetic oligonucleotide
ucaccagggggcauauauctt

SEQ ID NO: 2681 - DNA, 21 bp, Artificial Sequence
  Description of Artificial Sequence: Synthetic oligonucleotide
  Description of Combined DNA/RNA Molecule: Synthetic oligonucleotide
agcugugucgauuuucacctt

SEQ ID NO: 2682 - DNA, 21 bp, Artificial Sequence
  Description of Artificial Sequence: Synthetic oligonucleotide
  Description of Combined DNA/RNA Molecule: Synthetic oligonucleotide
uuuaauuagagcugugucgtt

SEQ ID NO: 2683 - DNA, 21 bp, Artificial Sequence
  Description of Artificial Sequence: Synthetic oligonucleotide
  Description of Combined DNA/RNA Molecule: Synthetic oligonucleotide
ugucagcuuuaauuagagctt

SEQ ID NO: 2684 - DNA, 21 bp, Artificial Sequence
  Description of Artificial Sequence: Synthetic oligonucleotide
  Description of Combined DNA/RNA Molecule: Synthetic oligonucleotide
ucaagcagaaaguugucagtt

SEQ ID NO: 2685 - DNA, 21 bp, Artificial Sequence
  Description of Artificial Sequence: Synthetic oligonucleotide
  Description of Combined DNA/RNA Molecule: Synthetic oligonucleotide
uguauuuucaagcagaaagtt

SEQ ID NO: 2686 - DNA, 21 bp, Artificial Sequence
  Description of Artificial Sequence: Synthetic oligonucleotide
  Description of Combined DNA/RNA Molecule: Synthetic oligonucleotide
ugggcuggcaguguauuuutt

SEQ ID NO: 2687 - DNA, 21 bp, Artificial Sequence
  Description of Artificial Sequence: Synthetic oligonucleotide
  Description of Combined DNA/RNA Molecule: Synthetic oligonucleotide
uguaaaggugcucugggcutt

SEQ ID NO: 2688 - DNA, 21 bp, Artificial Sequence
  Description of Artificial Sequence: Synthetic oligonucleotide
  Description of Combined DNA/RNA Molecule: Synthetic oligonucleotide
auggccaauguaaaggugctt

SEQ ID NO: 2689 - DNA, 21 bp, Artificial Sequence
  Description of Artificial Sequence: Synthetic oligonucleotide
  Description of Combined DNA/RNA Molecule: Synthetic oligonucleotide
acgcagaaauggccaaugutt

SEQ ID NO: 2690 - DNA, 21 bp, Artificial Sequence
  Description of Artificial Sequence: Synthetic oligonucleotide
  Description of Combined DNA/RNA Molecule: Synthetic oligonucleotide
agggaaagagcauacgcagtt

SEQ ID NO: 2691 - DNA, 21 bp, Artificial Sequence
  Description of Artificial Sequence: Synthetic oligonucleotide
  Description of Combined DNA/RNA Molecule: Synthetic oligonucleotide
uuuuaucucccagggaaagtt

SEQ ID NO: 2692 - DNA, 21 bp, Artificial Sequence
  Description of Artificial Sequence: Synthetic oligonucleotide
  Description of Combined DNA/RNA Molecule: Synthetic oligonucleotide
ugugggugaguuuuaucuctt

SEQ ID NO: 2693 - DNA, 21 bp, Artificial Sequence
  Description of Artificial Sequence: Synthetic oligonucleotide
  Description of Combined DNA/RNA Molecule: Synthetic oligonucleotide
aacgaaacugugggugagutt

SEQ ID NO: 2694 - DNA, 21 bp, Artificial Sequence
  Description of Artificial Sequence: Synthetic oligonucleotide
  Description of Combined DNA/RNA Molecule: Synthetic oligonucleotide
aaacaauugaacgaaacugtt

SEQ ID NO: 2695 - DNA, 21 bp, Artificial Sequence
  Description of Artificial Sequence: Synthetic oligonucleotide
  Description of Combined DNA/RNA Molecule: Synthetic oligonucleotide
uucaaagcugaaacaauugtt

SEQ ID NO: 2696 - DNA, 21 bp, Artificial Sequence
  Description of Artificial Sequence: Synthetic oligonucleotide
  Description of Combined DNA/RNA Molecule: Synthetic oligonucleotide
aaagcuucucucuucaaagtt

SEQ ID NO: 2697 - DNA, 21 bp, Artificial Sequence
  Description of Artificial Sequence: Synthetic oligonucleotide
  Description of Combined DNA/RNA Molecule: Synthetic oligonucleotide
uuuaaccaaagcuucucuctt

SEQ ID NO: 2698 - DNA, 21 bp, Artificial Sequence
  Description of Artificial Sequence: Synthetic oligonucleotide
  Description of Combined DNA/RNA Molecule: Synthetic oligonucleotide
uggguggauuaccuuuaactt

SEQ ID NO: 2699 - DNA, 21 bp, Artificial Sequence
  Description of Artificial Sequence: Synthetic oligonucleotide
  Description of Combined DNA/RNA Molecule: Synthetic oligonucleotide
aacgauaaauggguggauutt

SEQ ID NO: 2700 - DNA, 21 bp, Artificial Sequence
  Description of Artificial Sequence: Synthetic oligonucleotide
  Description of Combined DNA/RNA Molecule: Synthetic oligonucleotide
uuuccaaaaacgauaaaugtt

SEQ ID NO: 2701 - DNA, 21 bp, Artificial Sequence
  Description of Artificial Sequence: Synthetic oligonucleotide
  Description of Combined DNA/RNA Molecule: Synthetic oligonucleotide
ugaagauugucuuuccaaatt

SEQ ID NO: 2702 - DNA, 21 bp, Artificial Sequence
  Description of Artificial Sequence: Synthetic oligonucleotide
  Description of Combined DNA/RNA Molecule: Synthetic oligonucleotide
ugucuuuaugcugaagauutt

SEQ ID NO: 2703 - DNA, 21 bp, Artificial Sequence
  Description of Artificial Sequence: Synthetic oligonucleotide
  Description of Combined DNA/RNA Molecule: Synthetic oligonucleotide
accaguguuagguacagagtt

SEQ ID NO: 2704 - DNA, 21 bp, Artificial Sequence
  Description of Artificial Sequence: Synthetic oligonucleotide
  Description of Combined DNA/RNA Molecule: Synthetic oligonucleotide
auacgugccguaccagugutt

SEQ ID NO: 2705 - DNA, 21 bp, Artificial Sequence
  Description of Artificial Sequence: Synthetic oligonucleotide
  Description of Combined DNA/RNA Molecule: Synthetic oligonucleotide
uguuucuaccauacgugcctt

SEQ ID NO: 2706 - DNA, 21 bp, Artificial Sequence
  Description of Artificial Sequence: Synthetic oligonucleotide
  Description of Combined DNA/RNA Molecule: Synthetic oligonucleotide
auaggcaguuguuucuacctt

SEQ ID NO: 2707 - DNA, 21 bp, Artificial Sequence
  Description of Artificial Sequence: Synthetic oligonucleotide
  Description of Combined DNA/RNA Molecule: Synthetic oligonucleotide
aguaaagcauaggcaguugtt

SEQ ID NO: 2708 - DNA, 21 bp, Artificial Sequence
  Description of Artificial Sequence: Synthetic oligonucleotide
  Description of Combined DNA/RNA Molecule: Synthetic oligonucleotide
uucagacuggugaguaaagtt

SEQ ID NO: 2709 - DNA, 21 bp, Artificial Sequence
  Description of Artificial Sequence: Synthetic oligonucleotide
  Description of Combined DNA/RNA Molecule: Synthetic oligonucleotide
auaucuuucaaguucagactt

SEQ ID NO: 2710 - DNA, 21 bp, Artificial Sequence
  Description of Artificial Sequence: Synthetic oligonucleotide
  Description of Combined DNA/RNA Molecule: Synthetic oligonucleotide
uaauuuauaucuuucaagutt

SEQ ID NO: 2711 - DNA, 21 bp, Artificial Sequence
  Description of Artificial Sequence: Synthetic oligonucleotide
  Description of Combined DNA/RNA Molecule: Synthetic oligonucleotide
uggguuaacauaauuuauatt

SEQ ID NO: 2712 - DNA, 21 bp, Artificial Sequence
  Description of Artificial Sequence: Synthetic oligonucleotide
  Description of Combined DNA/RNA Molecule: Synthetic oligonucleotide
auuugaugacuggguuaactt

SEQ ID NO: 2713 - DNA, 21 bp, Artificial Sequence
  Description of Artificial Sequence: Synthetic oligonucleotide
  Description of Combined DNA/RNA Molecule: Synthetic oligonucleotide
ucugauagccauuugaugatt

SEQ ID NO: 2714 - DNA, 21 bp, Artificial Sequence
  Description of Artificial Sequence: Synthetic oligonucleotide
  Description of Combined DNA/RNA Molecule: Synthetic oligonucleotide
uaccucugcucuucugauatt

SEQ ID NO: 2715 - DNA, 21 bp, Artificial Sequence
  Description of Artificial Sequence: Synthetic oligonucleotide
  Description of Combined DNA/RNA Molecule: Synthetic oligonucleotide
aagccaccuccauaccucutt

SEQ ID NO: 2716 - DNA, 21 bp, Artificial Sequence
  Description of Artificial Sequence: Synthetic oligonucleotide
  Description of Combined DNA/RNA Molecule: Synthetic oligonucleotide
guugaauaaaagccaccuctt

SEQ ID NO: 2717 - DNA, 21 bp, Artificial Sequence
  Description of Artificial Sequence: Synthetic oligonucleotide
  Description of Combined DNA/RNA Molecule: Synthetic oligonucleotide
uuguguccuggguugaauatt

SEQ ID NO: 2718 - DNA, 21 bp, Artificial Sequence
  Description of Artificial Sequence: Synthetic oligonucleotide
  Description of Combined DNA/RNA Molecule: Synthetic oligonucleotide
auggcauugauuguguccutt

SEQ ID NO: 2719 - DNA, 21 bp, Artificial Sequence
  Description of Artificial Sequence: Synthetic oligonucleotide
  Description of Combined DNA/RNA Molecule: Synthetic oligonucleotide
cccucaauggcauugauugtt

SEQ ID NO: 2720 - DNA, 21 bp, Artificial Sequence
  Description of Artificial Sequence: Synthetic oligonucleotide
  Description of Combined DNA/RNA Molecule: Synthetic oligonucleotide
uuccgucaggcccucaaugtt

SEQ ID NO: 2721 - DNA, 21 bp, Artificial Sequence
  Description of Artificial Sequence: Synthetic oligonucleotide
  Description of Combined DNA/RNA Molecule: Synthetic oligonucleotide
ccaggagugaauauuccgutt

SEQ ID NO: 2722 - DNA, 21 bp, Artificial Sequence
  Description of Artificial Sequence: Synthetic oligonucleotide
  Description of Combined DNA/RNA Molecule: Synthetic oligonucleotide
uuguuuaaccaggagugaatt

SEQ ID NO: 2723 - DNA, 21 bp, Artificial Sequence
  Description of Artificial Sequence: Synthetic oligonucleotide
  Description of Combined DNA/RNA Molecule: Synthetic oligonucleotide
caagcggaguuguuuaacctt

SEQ ID NO: 2724 - DNA, 21 bp, Artificial Sequence
  Description of Artificial Sequence: Synthetic oligonucleotide
  Description of Combined DNA/RNA Molecule: Synthetic oligonucleotide
gauguccauacucaagcggtt

SEQ ID NO: 2725 - DNA, 21 bp, Artificial Sequence
  Description of Artificial Sequence: Synthetic oligonucleotide
  Description of Combined DNA/RNA Molecule: Synthetic oligonucleotide
guaagaaacaucgaugucctt

SEQ ID NO: 2726 - DNA, 21 bp, Artificial Sequence
  Description of Artificial Sequence: Synthetic oligonucleotide
  Description of Combined DNA/RNA Molecule: Synthetic oligonucleotide
augcuuguaagaaacaucgtt

SEQ ID NO: 2727 - DNA, 21 bp, Artificial Sequence
  Description of Artificial Sequence: Synthetic oligonucleotide
  Description of Combined DNA/RNA Molecule: Synthetic oligonucleotide
uaaggcaccuuuaugcuugtt

SEQ ID NO: 2728 - DNA, 21 bp, Artificial Sequence
  Description of Artificial Sequence: Synthetic oligonucleotide
  Description of Combined DNA/RNA Molecule: Synthetic oligonucleotide
uuauaauuauguaaggcactt

SEQ ID NO: 2729 - DNA, 21 bp, Artificial Sequence
  Description of Artificial Sequence: Synthetic oligonucleotide
  Description of Combined DNA/RNA Molecule: Synthetic oligonucleotide
ugucauuuuauaauuaugutt

SEQ ID NO: 2730 - DNA, 21 bp, Artificial Sequence
  Description of Artificial Sequence: Synthetic oligonucleotide
  Description of Combined DNA/RNA Molecule: Synthetic oligonucleotide
aauucuugucugucauuuutt

SEQ ID NO: 2731 - DNA, 21 bp, Artificial Sequence
  Description of Artificial Sequence: Synthetic oligonucleotide
  Description of Combined DNA/RNA Molecule: Synthetic oligonucleotide
ccucccaaggaaauucuugtt

SEQ ID NO: 2732 - DNA, 21 bp, Artificial Sequence
  Description of Artificial Sequence: Synthetic oligonucleotide
  Description of Combined DNA/RNA Molecule: Synthetic oligonucleotide
cucuacuggccucccaaggtt

SEQ ID NO: 2733 - DNA, 21 bp, Artificial Sequence
  Description of Artificial Sequence: Synthetic oligonucleotide
  Description of Combined DNA/RNA Molecule: Synthetic oligonucleotide
auugagaagcaccucuacutt

SEQ ID NO: 2734 - DNA, 21 bp, Artificial Sequence
  Description of Artificial Sequence: Synthetic oligonucleotide
  Description of Combined DNA/RNA Molecule: Synthetic oligonucleotide
ugaggucaucauugagaagtt

SEQ ID NO: 2735 - DNA, 21 bp, Artificial Sequence
  Description of Artificial Sequence: Synthetic oligonucleotide
  Description of Combined DNA/RNA Molecule: Synthetic oligonucleotide
uguacugacaaugaggucatt

SEQ ID NO: 2736 - DNA, 21 bp, Artificial Sequence
  Description of Artificial Sequence: Synthetic oligonucleotide
  Description of Combined DNA/RNA Molecule: Synthetic oligonucleotide
ugccaaauccuguacugactt

SEQ ID NO: 2737 - DNA, 21 bp, Artificial Sequence
  Description of Artificial Sequence: Synthetic oligonucleotide
  Description of Combined DNA/RNA Molecule: Synthetic oligonucleotide
caagccacugccaaauccutt

SEQ ID NO: 2738 - DNA, 21 bp, Artificial Sequence
  Description of Artificial Sequence: Synthetic oligonucleotide
  Description of Combined DNA/RNA Molecule: Synthetic oligonucleotide
auguacuguagccaagccatt

SEQ ID NO: 2739 - DNA, 21 bp, Artificial Sequence
  Description of Artificial Sequence: Synthetic oligonucleotide
  Description of Combined DNA/RNA Molecule: Synthetic oligonucleotide
uuguuacauguacuguagctt

SEQ ID NO: 2740 - DNA, 21 bp, Artificial Sequence
  Description of Artificial Sequence: Synthetic oligonucleotide
  Description of Combined DNA/RNA Molecule: Synthetic oligonucleotide
uuugugaacuacaguuguutt

SEQ ID NO: 2741 - DNA, 21 bp, Artificial Sequence
  Description of Artificial Sequence: Synthetic oligonucleotide
  Description of Combined DNA/RNA Molecule: Synthetic oligonucleotide
uacugguuuugugaacuactt

SEQ ID NO: 2742 - DNA, 21 bp, Artificial Sequence
  Description of Artificial Sequence: Synthetic oligonucleotide
  Description of Combined DNA/RNA Molecule: Synthetic oligonucleotide
uccucagagguacugguuutt

SEQ ID NO: 2743 - DNA, 21 bp, Artificial Sequence
  Description of Artificial Sequence: Synthetic oligonucleotide
  Description of Combined DNA/RNA Molecule: Synthetic oligonucleotide
aaagcugcaaacuuccucatt

SEQ ID NO: 2744 - DNA, 21 bp, Artificial Sequence
  Description of Artificial Sequence: Synthetic oligonucleotide
  Description of Combined DNA/RNA Molecule: Synthetic oligonucleotide
uuuucaaauaaaagcugcatt

SEQ ID NO: 2745 - DNA, 21 bp, Artificial Sequence
  Description of Artificial Sequence: Synthetic oligonucleotide
  Description of Combined DNA/RNA Molecule: Synthetic oligonucleotide
ugaguaucgauuuucaaautt

SEQ ID NO: 2746 - DNA, 21 bp, Artificial Sequence
  Description of Artificial Sequence: Synthetic oligonucleotide
  Description of Combined DNA/RNA Molecule: Synthetic oligonucleotide
uucaauauccugaguaucgtt

SEQ ID NO: 2747 - DNA, 21 bp, Artificial Sequence
  Description of Artificial Sequence: Synthetic oligonucleotide
  Description of Combined DNA/RNA Molecule: Synthetic oligonucleotide
gugggaugcuucaauaucctt

SEQ ID NO: 2748 - DNA, 21 bp, Artificial Sequence
  Description of Artificial Sequence: Synthetic oligonucleotide
  Description of Combined DNA/RNA Molecule: Synthetic oligonucleotide
cucuguagugggaugcuuctt

SEQ ID NO: 2749 - DNA, 21 bp, Artificial Sequence
  Description of Artificial Sequence: Synthetic oligonucleotide
  Description of Combined DNA/RNA Molecule: Synthetic oligonucleotide
uuuccguagccucuguagutt

SEQ ID NO: 2750 - DNA, 21 bp, Artificial Sequence
  Description of Artificial Sequence: Synthetic oligonucleotide
  Description of Combined DNA/RNA Molecule: Synthetic oligonucleotide
uuuguaaucagaguuuccgtt

SEQ ID NO: 2751 - DNA, 21 bp, Artificial Sequence
  Description of Artificial Sequence: Synthetic oligonucleotide
  Description of Combined DNA/RNA Molecule: Synthetic oligonucleotide
uacuaugcguuuguaaucatt

SEQ ID NO: 2752 - DNA, 21 bp, Artificial Sequence
  Description of Artificial Sequence: Synthetic oligonucleotide
  Description of Combined DNA/RNA Molecule: Synthetic oligonucleotide
cuggcacaugcuacuaugctt

SEQ ID NO: 2753 - DNA, 21 bp, Artificial Sequence
  Description of Artificial Sequence: Synthetic oligonucleotide
  Description of Combined DNA/RNA Molecule: Synthetic oligonucleotide
gcuuguagcuggcacaugctt

SEQ ID NO: 2754 - DNA, 21 bp, Artificial Sequence
  Description of Artificial Sequence: Synthetic oligonucleotide
  Description of Combined DNA/RNA Molecule: Synthetic oligonucleotide
uucccugcugggcuuguagtt

SEQ ID NO: 2755 - DNA, 21 bp, Artificial Sequence
  Description of Artificial Sequence: Synthetic oligonucleotide
  Description of Combined DNA/RNA Molecule: Synthetic oligonucleotide
ugaugauucuucccugcugtt

SEQ ID NO: 2756 - DNA, 21 bp, Artificial Sequence
  Description of Artificial Sequence: Synthetic oligonucleotide
  Description of Combined DNA/RNA Molecule: Synthetic oligonucleotide
aggauccagaugaugauuctt

SEQ ID NO: 2757 - DNA, 21 bp, Artificial Sequence
  Description of Artificial Sequence: Synthetic oligonucleotide
  Description of Combined DNA/RNA Molecule: Synthetic oligonucleotide
aucaccgcaugagaggauctt

SEQ ID NO: 2758 - DNA, 21 bp, Artificial Sequence
  Description of Artificial Sequence: Synthetic oligonucleotide
  Description of Combined DNA/RNA Molecule: Synthetic oligonucleotide
auguccaucaccgcaugagtt

SEQ ID NO: 2759 - DNA, 21 bp, Artificial Sequence
  Description of Artificial Sequence: Synthetic oligonucleotide
  Description of Combined DNA/RNA Molecule: Synthetic oligonucleotide
aggcaaggagauguccauctt

SEQ ID NO: 2760 - DNA, 21 bp, Artificial Sequence
  Description of Artificial Sequence: Synthetic oligonucleotide
  Description of Combined DNA/RNA Molecule: Synthetic oligonucleotide
acugauuccaguaggcaagtt

SEQ ID NO: 2761 - DNA, 21 bp, Artificial Sequence
  Description of Artificial Sequence: Synthetic oligonucleotide
  Description of Combined DNA/RNA Molecule: Synthetic oligonucleotide
ucuucauuugcacugauuctt

SEQ ID NO: 2762 - DNA, 21 bp, Artificial Sequence
  Description of Artificial Sequence: Synthetic oligonucleotide
  Description of Combined DNA/RNA Molecule: Synthetic oligonucleotide
uuuuaagucuucuucauuutt

SEQ ID NO: 2763 - DNA, 21 bp, Artificial Sequence
  Description of Artificial Sequence: Synthetic oligonucleotide
  Description of Combined DNA/RNA Molecule: Synthetic oligonucleotide
caagggcuuuuaagucuuctt

SEQ ID NO: 2764 - DNA, 21 bp, Artificial Sequence
  Description of Artificial Sequence: Synthetic oligonucleotide
  Description of Combined DNA/RNA Molecule: Synthetic oligonucleotide
auccaccccuuccacaaggtt

SEQ ID NO: 2765 - DNA, 21 bp, Artificial Sequence
  Description of Artificial Sequence: Synthetic oligonucleotide
  Description of Combined DNA/RNA Molecule: Synthetic oligonucleotide
auaguugauccaccccuuctt

SEQ ID NO: 2766 - DNA, 21 bp, Artificial Sequence
  Description of Artificial Sequence: Synthetic oligonucleotide
  Description of Combined DNA/RNA Molecule: Synthetic oligonucleotide
uaaucagugaauaguugautt

SEQ ID NO: 2767 - DNA, 21 bp, Artificial Sequence
  Description of Artificial Sequence: Synthetic oligonucleotide
  Description of Combined DNA/RNA Molecule: Synthetic oligonucleotide
uuugauuugguaaucagugtt

SEQ ID NO: 2768 - DNA, 21 bp, Artificial Sequence
  Description of Artificial Sequence: Synthetic oligonucleotide
  Description of Combined DNA/RNA Molecule: Synthetic oligonucleotide
uaacauguccaucuuugautt

SEQ ID NO: 2769 - DNA, 21 bp, Artificial Sequence
  Description of Artificial Sequence: Synthetic oligonucleotide
  Description of Combined DNA/RNA Molecule: Synthetic oligonucleotide
guugcagaauaacaugucctt

SEQ ID NO: 2770 - DNA, 21 bp, Artificial Sequence
  Description of Artificial Sequence: Synthetic oligonucleotide
  Description of Combined DNA/RNA Molecule: Synthetic oligonucleotide
aaucgaauucaguugcagatt

SEQ ID NO: 2771 - DNA, 21 bp, Artificial Sequence
  Description of Artificial Sequence: Synthetic oligonucleotide
  Description of Combined DNA/RNA Molecule: Synthetic oligonucleotide
acuggagggaaucgaauuctt

SEQ ID NO: 2772 - DNA, 21 bp, Artificial Sequence
  Description of Artificial Sequence: Synthetic oligonucleotide
  Description of Combined DNA/RNA Molecule: Synthetic oligonucleotide
aaaggaaaucacuggagggtt

SEQ ID NO: 2773 - DNA, 21 bp, Artificial Sequence
  Description of Artificial Sequence: Synthetic oligonucleotide
  Description of Combined DNA/RNA Molecule: Synthetic oligonucleotide
aucguacacaaaggaaauctt

SEQ ID NO: 2774 - DNA, 21 bp, Artificial Sequence
  Description of Artificial Sequence: Synthetic oligonucleotide
  Description of Combined DNA/RNA Molecule: Synthetic oligonucleotide
caaauauccggaaucguactt

SEQ ID NO: 2775 - DNA, 21 bp, Artificial Sequence
  Description of Artificial Sequence: Synthetic oligonucleotide
  Description of Combined DNA/RNA Molecule: Synthetic oligonucleotide
caaagaguucaaauauccgtt

SEQ ID NO: 2776 - DNA, 21 bp, Artificial Sequence
  Description of Artificial Sequence: Synthetic oligonucleotide
  Description of Combined DNA/RNA Molecule: Synthetic oligonucleotide
aaacccaacuucaaagagutt

SEQ ID NO: 2777 - DNA, 21 bp, Artificial Sequence
  Description of Artificial Sequence: Synthetic oligonucleotide
  Description of Combined DNA/RNA Molecule: Synthetic oligonucleotide
aggacugagaaacccaacutt

SEQ ID NO: 2778 - DNA, 21 bp, Artificial Sequence
  Description of Artificial Sequence: Synthetic oligonucleotide
  Description of Combined DNA/RNA Molecule: Synthetic oligonucleotide
aaaguggcaggacugagaatt

SEQ ID NO: 2779 - DNA, 21 bp, Artificial Sequence
  Description of Artificial Sequence: Synthetic oligonucleotide
  Description of Combined DNA/RNA Molecule: Synthetic oligonucleotide
uucguacacugugaaagugtt

SEQ ID NO: 2780 - DNA, 21 bp, Artificial Sequence
  Description of Artificial Sequence: Synthetic oligonucleotide
  Description of Combined DNA/RNA Molecule: Synthetic oligonucleotide
gugguauucguacacugugtt

SEQ ID NO: 2781 - DNA, 21 bp, Artificial Sequence
  Description of Artificial Sequence: Synthetic oligonucleotide
  Description of Combined DNA/RNA Molecule: Synthetic oligonucleotide
uguuuaucuggucuguggutt

SEQ ID NO: 2782 - DNA, 21 bp, Artificial Sequence
  Description of Artificial Sequence: Synthetic oligonucleotide
  Description of Combined DNA/RNA Molecule: Synthetic oligonucleotide
ugguacacuguuuaucuggtt

SEQ ID NO: 2783 - DNA, 21 bp, Artificial Sequence
  Description of Artificial Sequence: Synthetic oligonucleotide
  Description of Combined DNA/RNA Molecule: Synthetic oligonucleotide
uauaaaacaugguacacugtt

SEQ ID NO: 2784 - DNA, 21 bp, Artificial Sequence
  Description of Artificial Sequence: Synthetic oligonucleotide
  Description of Combined DNA/RNA Molecule: Synthetic oligonucleotide
auuggaagugcuauaaaactt

SEQ ID NO: 2785 - DNA, 21 bp, Artificial Sequence
  Description of Artificial Sequence: Synthetic oligonucleotide
  Description of Combined DNA/RNA Molecule: Synthetic oligonucleotide
ugaauuuugauauuggaagtt

SEQ ID NO: 2786 - DNA, 21 bp, Artificial Sequence
  Description of Artificial Sequence: Synthetic oligonucleotide
  Description of Combined DNA/RNA Molecule: Synthetic oligonucleotide
agacuuucugaauuuugautt

SEQ ID NO: 2787 - DNA, 21 bp, Artificial Sequence
  Description of Artificial Sequence: Synthetic oligonucleotide
  Description of Combined DNA/RNA Molecule: Synthetic oligonucleotide
ggcuccuucacagacuuuctt

SEQ ID NO: 2788 - DNA, 21 bp, Artificial Sequence
  Description of Artificial Sequence: Synthetic oligonucleotide
  Description of Combined DNA/RNA Molecule: Synthetic oligonucleotide
acuugcacgcggcuccuuctt

SEQ ID NO: 2789 - DNA, 21 bp, Artificial Sequence
  Description of Artificial Sequence: Synthetic oligonucleotide
  Description of Combined DNA/RNA Molecule: Synthetic oligonucleotide
gcuucuacacacuugcacgtt

SEQ ID NO: 2790 - DNA, 21 bp, Artificial Sequence
  Description of Artificial Sequence: Synthetic oligonucleotide
  Description of Combined DNA/RNA Molecule: Synthetic oligonucleotide
gcccacaaucagcuucuactt

SEQ ID NO: 2791 - DNA, 21 bp, Artificial Sequence
  Description of Artificial Sequence: Synthetic oligonucleotide
  Description of Combined DNA/RNA Molecule: Synthetic oligonucleotide
ugcauuugcccacaaucagtt

SEQ ID NO: 2792 - DNA, 21 bp, Artificial Sequence
  Description of Artificial Sequence: Synthetic oligonucleotide
  Description of Combined DNA/RNA Molecule: Synthetic oligonucleotide
caauucuuccugcauuugctt

SEQ ID NO: 2793 - DNA, 21 bp, Artificial Sequence
  Description of Artificial Sequence: Synthetic oligonucleotide
  Description of Combined DNA/RNA Molecule: Synthetic oligonucleotide
uugucagauccaauucuuctt

SEQ ID NO: 2794 - DNA, 21 bp, Artificial Sequence
  Description of Artificial Sequence: Synthetic oligonucleotide
  Description of Combined DNA/RNA Molecule: Synthetic oligonucleotide
ucucugcagagauugucagtt

SEQ ID NO: 2795 - DNA, 21 bp, Artificial Sequence
  Description of Artificial Sequence: Synthetic oligonucleotide
  Description of Combined DNA/RNA Molecule: Synthetic oligonucleotide
uuuguuuucuugucucugctt

SEQ ID NO: 2796 - DNA, 21 bp, Artificial Sequence
  Description of Artificial Sequence: Synthetic oligonucleotide
  Description of Combined DNA/RNA Molecule: Synthetic oligonucleotide
caugcuguuuguuuucuugtt

SEQ ID NO: 2797 - DNA, 21 bp, Artificial Sequence
  Description of Artificial Sequence: Synthetic oligonucleotide
  Description of Combined DNA/RNA Molecule: Synthetic oligonucleotide
ucucugguuuacaugcugutt

SEQ ID NO: 2798 - DNA, 21 bp, Artificial Sequence
  Description of Artificial Sequence: Synthetic oligonucleotide
  Description of Combined DNA/RNA Molecule: Synthetic oligonucleotide
aagcauaugcaaucucuggtt

SEQ ID NO: 2799 - DNA, 21 bp, Artificial Sequence
  Description of Artificial Sequence: Synthetic oligonucleotide
  Description of Combined DNA/RNA Molecule: Synthetic oligonucleotide
uaacuuuauaagcauaugctt

SEQ ID NO: 2800 - DNA, 21 bp, Artificial Sequence
  Description of Artificial Sequence: Synthetic oligonucleotide
  Description of Combined DNA/RNA Molecule: Synthetic oligonucleotide
ugugaugcuaacuuuauaatt

SEQ ID NO: 2801 - DNA, 21 bp, Artificial Sequence
  Description of Artificial Sequence: Synthetic oligonucleotide
  Description of Combined DNA/RNA Molecule: Synthetic oligonucleotide
uacagugauggaugugaugtt

SEQ ID NO: 2802 - DNA, 21 bp, Artificial Sequence
  Description of Artificial Sequence: Synthetic oligonucleotide
  Description of Combined DNA/RNA Molecule: Synthetic oligonucleotide
aaaacauuuucuacagugatt

SEQ ID NO: 2803 - DNA, 21 bp, Artificial Sequence
  Description of Artificial Sequence: Synthetic oligonucleotide
  Description of Combined DNA/RNA Molecule: Synthetic oligonucleotide
cuugacaaaaacauuuucutt

SEQ ID NO: 2804 - DNA, 21 bp, Artificial Sequence
  Description of Artificial Sequence: Synthetic oligonucleotide
  Description of Combined DNA/RNA Molecule: Synthetic oligonucleotide
uugccuuguacuugacaaatt

SEQ ID NO: 2805 - DNA, 21 bp, Artificial Sequence
  Description of Artificial Sequence: Synthetic oligonucleotide
  Description of Combined DNA/RNA Molecule: Synthetic oligonucleotide
auauccagaaggguugccutt

SEQ ID NO: 2806 - DNA, 21 bp, Artificial Sequence
  Description of Artificial Sequence: Synthetic oligonucleotide
  Description of Combined DNA/RNA Molecule: Synthetic oligonucleotide
uuuguagauauccagaaggtt

SEQ ID NO: 2807 - DNA, 21 bp, Artificial Sequence
  Description of Artificial Sequence: Synthetic oligonucleotide
  Description of Combined DNA/RNA Molecule: Synthetic oligonucleotide
uuccccaguuuuguagauatt

SEQ ID NO: 2808 - DNA, 21 bp, Artificial Sequence
  Description of Artificial Sequence: Synthetic oligonucleotide
  Description of Combined DNA/RNA Molecule: Synthetic oligonucleotide
ucagcaacagcuuccccagtt

SEQ ID NO: 2809 - DNA, 21 bp, Artificial Sequence
  Description of Artificial Sequence: Synthetic oligonucleotide
  Description of Combined DNA/RNA Molecule: Synthetic oligonucleotide
gagucuuucucagcaacagtt

SEQ ID NO: 2810 - DNA, 21 bp, Artificial Sequence
  Description of Artificial Sequence: Synthetic oligonucleotide
  Description of Combined DNA/RNA Molecule: Synthetic oligonucleotide
ugaagguaaucucagaguctt

SEQ ID NO: 2811 - DNA, 21 bp, Artificial Sequence
  Description of Artificial Sequence: Synthetic oligonucleotide
  Description of Combined DNA/RNA Molecule: Synthetic oligonucleotide
uuuuaaugaagguaaucuctt

SEQ ID NO: 2812 - DNA, 21 bp, Artificial Sequence
  Description of Artificial Sequence: Synthetic oligonucleotide
  Description of Combined DNA/RNA Molecule: Synthetic oligonucleotide
uacagguuaccuuuuuaautt

SEQ ID NO: 2813 - DNA, 21 bp, Artificial Sequence
  Description of Artificial Sequence: Synthetic oligonucleotide
  Description of Combined DNA/RNA Molecule: Synthetic oligonucleotide
ucagcguuaguacagguuatt

SEQ ID NO: 2814 - DNA, 21 bp, Artificial Sequence
  Description of Artificial Sequence: Synthetic oligonucleotide
  Description of Combined DNA/RNA Molecule: Synthetic oligonucleotide
uuuaccagcucagcguuagtt

SEQ ID NO: 2815 - DNA, 21 bp, Artificial Sequence
  Description of Artificial Sequence: Synthetic oligonucleotide
  Description of Combined DNA/RNA Molecule: Synthetic oligonucleotide
guacugucuuccuuuuacctt

SEQ ID NO: 2816 - DNA, 21 bp, Artificial Sequence
  Description of Artificial Sequence: Synthetic oligonucleotide
  Description of Combined DNA/RNA Molecule: Synthetic oligonucleotide
auaauuaaguacugucuuctt

SEQ ID NO: 2817 - DNA, 21 bp, Artificial Sequence
  Description of Artificial Sequence: Synthetic oligonucleotide
  Description of Combined DNA/RNA Molecule: Synthetic oligonucleotide
uucuuuacccauaauuaagtt

SEQ ID NO: 2818 - DNA, 21 bp, Artificial Sequence
  Description of Artificial Sequence: Synthetic oligonucleotide
  Description of Combined DNA/RNA Molecule: Synthetic oligonucleotide
uaucuggagggcuucuuuatt

SEQ ID NO: 2819 - DNA, 21 bp, Artificial Sequence
  Description of Artificial Sequence: Synthetic oligonucleotide
  Description of Combined DNA/RNA Molecule: Synthetic oligonucleotide
auuguauuuuaucuggaggtt

SEQ ID NO: 2820 - DNA, 21 bp, Artificial Sequence
  Description of Artificial Sequence: Synthetic oligonucleotide
  Description of Combined DNA/RNA Molecule: Synthetic oligonucleotide
ugaaacugaaauuguauuutt

SEQ ID NO: 2821 - DNA, 21 bp, Artificial Sequence
  Description of Artificial Sequence: Synthetic oligonucleotide
  Description of Combined DNA/RNA Molecule: Synthetic oligonucleotide
guagauguaccugaaacugtt

SEQ ID NO: 2822 - DNA, 21 bp, Artificial Sequence
  Description of Artificial Sequence: Synthetic oligonucleotide
  Description of Combined DNA/RNA Molecule: Synthetic oligonucleotide
ucuaaaggguagauguacctt

SEQ ID NO: 2823 - DNA, 21 bp, Artificial Sequence
  Description of Artificial Sequence: Synthetic oligonucleotide
  Description of Combined DNA/RNA Molecule: Synthetic oligonucleotide
aggucaaggaaucuaaaggtt

SEQ ID NO: 2824 - DNA, 21 bp, Artificial Sequence
  Description of Artificial Sequence: Synthetic oligonucleotide
  Description of Combined DNA/RNA Molecule: Synthetic oligonucleotide
uauucaauccaggucaaggtt

SEQ ID NO: 2825 - DNA, 21 bp, Artificial Sequence
  Description of Artificial Sequence: Synthetic oligonucleotide
  Description of Combined DNA/RNA Molecule: Synthetic oligonucleotide
cuaggccaguauucaaucctt

SEQ ID NO: 2826 - DNA, 21 bp, Artificial Sequence
  Description of Artificial Sequence: Synthetic oligonucleotide
  Description of Combined DNA/RNA Molecule: Synthetic oligonucleotide
uguugugucucuaggccagtt

SEQ ID NO: 2827 - DNA, 21 bp, Artificial Sequence
  Description of Artificial Sequence: Synthetic oligonucleotide
  Description of Combined DNA/RNA Molecule: Synthetic oligonucleotide
gaugaacauguugugucuctt

SEQ ID NO: 2828 - DNA, 21 bp, Artificial Sequence
  Description of Artificial Sequence: Synthetic oligonucleotide
  Description of Combined DNA/RNA Molecule: Synthetic oligonucleotide
aaugcuugacacgaugaactt

SEQ ID NO: 2829 - DNA, 21 bp, Artificial Sequence
  Description of Artificial Sequence: Synthetic oligonucleotide
  Description of Combined DNA/RNA Molecule: Synthetic oligonucleotide
uuagcuaaaaaugcuugactt

SEQ ID NO: 2830 - DNA, 21 bp, Artificial Sequence
  Description of Artificial Sequence: Synthetic oligonucleotide
  Description of Combined DNA/RNA Molecule: Synthetic oligonucleotide
aaauucaucuaaauuagcutt

SEQ ID NO: 2831 - DNA, 21 bp, Artificial Sequence
  Description of Artificial Sequence: Synthetic oligonucleotide
  Description of Combined DNA/RNA Molecule: Synthetic oligonucleotide
aucuucggcaaauucaucutt

SEQ ID NO: 2832 - DNA, 21 bp, Artificial Sequence
  Description of Artificial Sequence: Synthetic oligonucleotide
  Description of Combined DNA/RNA Molecule: Synthetic oligonucleotide
uuuaaaaagauaucuucggtt

SEQ ID NO: 2833 - DNA, 21 bp, Artificial Sequence
  Description of Artificial Sequence: Synthetic oligonucleotide
  Description of Combined DNA/RNA Molecule: Synthetic oligonucleotide
uuagcauccauuuaaaaagtt

SEQ ID NO: 2834 - DNA, 21 bp, Artificial Sequence
  Description of Artificial Sequence: Synthetic oligonucleotide
  Description of Combined DNA/RNA Molecule: Synthetic oligonucleotide
uucaggaauuuuagcaucctt

SEQ ID NO: 2835 - DNA, 21 bp, Artificial Sequence
  Description of Artificial Sequence: Synthetic oligonucleotide
  Description of Combined DNA/RNA Molecule: Synthetic oligonucleotide
cugaacuucaggaauuuuatt

SEQ ID NO: 2836 - DNA, 21 bp, Artificial Sequence
  Description of Artificial Sequence: Synthetic oligonucleotide
  Description of Combined DNA/RNA Molecule: Synthetic oligonucleotide
aacuguaugcagcugaacutt

SEQ ID NO: 2837 - DNA, 21 bp, Artificial Sequence
  Description of Artificial Sequence: Synthetic oligonucleotide
  Description of Combined DNA/RNA Molecule: Synthetic oligonucleotide
auaagugcaaacuguaugctt

SEQ ID NO: 2838 - DNA, 21 bp, Artificial Sequence
  Description of Artificial Sequence: Synthetic oligonucleotide
  Description of Combined DNA/RNA Molecule: Synthetic oligonucleotide
acaacaggaguccauaagutt

SEQ ID NO: 2839 - DNA, 21 bp, Artificial Sequence
  Description of Artificial Sequence: Synthetic oligonucleotide
  Description of Combined DNA/RNA Molecule: Synthetic oligonucleotide
acuucaacaacaggagucctt

SEQ ID NO: 2840 - DNA, 21 bp, Artificial Sequence
  Description of Artificial Sequence: Synthetic oligonucleotide
  Description of Combined DNA/RNA Molecule: Synthetic oligonucleotide
aaaaaaacgaacuucaacatt

SEQ ID NO: 2841 - DNA, 21 bp, Artificial Sequence
  Description of Artificial Sequence: Synthetic oligonucleotide
  Description of Combined DNA/RNA Molecule: Synthetic oligonucleotide
aaaagaagaaaacaaaaaatt

SEQ ID NO: 2842 - DNA, 21 bp, Artificial Sequence
  Description of Artificial Sequence: Synthetic oligonucleotide
  Description of Combined DNA/RNA Molecule: Synthetic oligonucleotide
aauguuuaaaaaaagaagatt

SEQ ID NO: 2843 - DNA, 21 bp, Artificial Sequence
  Description of Artificial Sequence: Synthetic oligonucleotide
  Description of Combined DNA/RNA Molecule: Synthetic oligonucleotide
agcuaugaauguuuaaaaatt

SEQ ID NO: 2844 - DNA, 21 bp, Artificial Sequence
  Description of Artificial Sequence: Synthetic oligonucleotide
  Description of Combined DNA/RNA Molecule: Synthetic oligonucleotide
uacaaauaagaccagcuautt

SEQ ID NO: 2845 - DNA, 21 bp, Artificial Sequence
  Description of Artificial Sequence: Synthetic oligonucleotide
  Description of Combined DNA/RNA Molecule: Synthetic oligonucleotide
ugagcuuuacaaauaagactt

SEQ ID NO: 2846 - DNA, 21 bp, Artificial Sequence
  Description of Artificial Sequence: Synthetic oligonucleotide
  Description of Combined DNA/RNA Molecule: Synthetic oligonucleotide
ucuaaguaaagugagcuuutt

SEQ ID NO: 2847 - DNA, 21 bp, Artificial Sequence
  Description of Artificial Sequence: Synthetic oligonucleotide
  Description of Combined DNA/RNA Molecule: Synthetic oligonucleotide
agugccacuaauucuaagutt

SEQ ID NO: 2848 - DNA, 21 bp, Artificial Sequence
  Description of Artificial Sequence: Synthetic oligonucleotide
  Description of Combined DNA/RNA Molecule: Synthetic oligonucleotide
aauaaaagcaagugccacutt

SEQ ID NO: 2849 - DNA, 21 bp, Artificial Sequence
  Description of Artificial Sequence: Synthetic oligonucleotide
  Description of Combined DNA/RNA Molecule: Synthetic oligonucleotide
aucauucucuaauaaaagctt

SEQ ID NO: 2850 - DNA, 21 bp, Artificial Sequence
  Description of Artificial Sequence: Synthetic oligonucleotide
  Description of Combined DNA/RNA Molecule: Synthetic oligonucleotide
agcauuugaaaucauucuctt

SEQ ID NO: 2851 - DNA, 21 bp, Artificial Sequence
  Description of Artificial Sequence: Synthetic oligonucleotide
  Description of Combined DNA/RNA Molecule: Synthetic oligonucleotide
aaaguuacagcauuugaaatt

SEQ ID NO: 2852 - DNA, 21 bp, Artificial Sequence
  Description of Artificial Sequence: Synthetic oligonucleotide
  Description of Combined DNA/RNA Molecule: Synthetic oligonucleotide
uguuauuucagaaaguuactt

SEQ ID NO: 2853 - DNA, 21 bp, Artificial Sequence
  Description of Artificial Sequence: Synthetic oligonucleotide
  Description of Combined DNA/RNA Molecule: Synthetic oligonucleotide
uccaaggccauguuauuuctt

SEQ ID NO: 2854 - DNA, 21 bp, Artificial Sequence
  Description of Artificial Sequence: Synthetic oligonucleotide
  Description of Combined DNA/RNA Molecule: Synthetic oligonucleotide
gucuucaugcccuccaaggtt

SEQ ID NO: 2855 - DNA, 21 bp, Artificial Sequence
  Description of Artificial Sequence: Synthetic oligonucleotide
  Description of Combined DNA/RNA Molecule: Synthetic oligonucleotide
guaucugucuucaugcccutt

SEQ ID NO: 2856 - DNA, 21 bp, Artificial Sequence
  Description of Artificial Sequence: Synthetic oligonucleotide
  Description of Combined DNA/RNA Molecule: Synthetic oligonucleotide
auaaccuuggaggaguauctt

SEQ ID NO: 2857 - DNA, 21 bp, Artificial Sequence
  Description of Artificial Sequence: Synthetic oligonucleotide
  Description of Combined DNA/RNA Molecule: Synthetic oligonucleotide
uguccaauaaccuuggaggtt

SEQ ID NO: 2858 - DNA, 21 bp, Artificial Sequence
  Description of Artificial Sequence: Synthetic oligonucleotide
  Description of Combined DNA/RNA Molecule: Synthetic oligonucleotide
uuuauuguuuccggugucctt

SEQ ID NO: 2859 - DNA, 21 bp, Artificial Sequence
  Description of Artificial Sequence: Synthetic oligonucleotide
  Description of Combined DNA/RNA Molecule: Synthetic oligonucleotide
uguuccaauuuauuguuuctt

SEQ ID NO: 2860 - DNA, 21 bp, Artificial Sequence
  Description of Artificial Sequence: Synthetic oligonucleotide
  Description of Combined DNA/RNA Molecule: Synthetic oligonucleotide
uuugaggagguguuccaautt

SEQ ID NO: 2861 - DNA, 21 bp, Artificial Sequence
  Description of Artificial Sequence: Synthetic oligonucleotide
  Description of Combined DNA/RNA Molecule: Synthetic oligonucleotide
ugagugguagguuugaggatt

SEQ ID NO: 2862 - DNA, 21 bp, Artificial Sequence
  Description of Artificial Sequence: Synthetic oligonucleotide
  Description of Combined DNA/RNA Molecule: Synthetic oligonucleotide
aaacauuccugagugguagtt

SEQ ID NO: 2863 - DNA, 21 bp, Artificial Sequence
  Description of Artificial Sequence: Synthetic oligonucleotide
  Description of Combined DNA/RNA Molecule: Synthetic oligonucleotide
uucggccccagcaaacauutt

SEQ ID NO: 2864 - DNA, 21 bp, Artificial Sequence
  Description of Artificial Sequence: Synthetic oligonucleotide
  Description of Combined DNA/RNA Molecule: Synthetic oligonucleotide
uguucuuucggccccagcatt

SEQ ID NO: 2865 - DNA, 21 bp, Artificial Sequence
  Description of Artificial Sequence: Synthetic oligonucleotide
  Description of Combined DNA/RNA Molecule: Synthetic oligonucleotide
uuucaauggacuguucuuutt

SEQ ID NO: 2866 - DNA, 21 bp, Artificial Sequence
  Description of Artificial Sequence: Synthetic oligonucleotide
  Description of Combined DNA/RNA Molecule: Synthetic oligonucleotide
guaauacucccuuucaaugtt

SEQ ID NO: 2867 - DNA, 21 bp, Artificial Sequence
  Description of Artificial Sequence: Synthetic oligonucleotide
  Description of Combined DNA/RNA Molecule: Synthetic oligonucleotide
cauguuuuuguaauacucctt

SEQ ID NO: 2868 - DNA, 21 bp, Artificial Sequence
  Description of Artificial Sequence: Synthetic oligonucleotide
  Description of Combined DNA/RNA Molecule: Synthetic oligonucleotide
caagcaaaggccauguuuutt

SEQ ID NO: 2869 - DNA, 21 bp, Artificial Sequence
  Description of Artificial Sequence: Synthetic oligonucleotide
  Description of Combined DNA/RNA Molecule: Synthetic oligonucleotide
uuuucuuucaagcaaaggctt

SEQ ID NO: 2870 - DNA, 21 bp, Artificial Sequence
  Description of Artificial Sequence: Synthetic oligonucleotide
  Description of Combined DNA/RNA Molecule: Synthetic oligonucleotide
uuccuugguauuuucuuuctt

SEQ ID NO: 2871 - DNA, 21 bp, Artificial Sequence
  Description of Artificial Sequence: Synthetic oligonucleotide
  Description of Combined DNA/RNA Molecule: Synthetic oligonucleotide
ucaguuuccuguuccuuggtt

SEQ ID NO: 2872 - DNA, 21 bp, Artificial Sequence
  Description of Artificial Sequence: Synthetic oligonucleotide
  Description of Combined DNA/RNA Molecule: Synthetic oligonucleotide
caggcuuuaaugaucaguutt

SEQ ID NO: 2873 - RNA, 21 nt, Artificial Sequence
  Description of Artificial Sequence: Synthetic oligonucleotide
aagcaagauauuuuuauaaua

SEQ ID NO: 2874 - RNA, 21 nt, Artificial Sequence
  Description of Artificial Sequence: Synthetic oligonucleotide
aagcaagauauuuuuauaaua

SEQ ID NO: 2875 - RNA, 21 nt, Artificial Sequence
  Description of Artificial Sequence: Synthetic oligonucleotide
aagcaagauauuuuuauaaua

SEQ ID NO: 2876 - RNA, 21 nt, Artificial Sequence
  Description of Artificial Sequence: Synthetic oligonucleotide
aagcaagauauuuuuauaaua

SEQ ID NO: 2877 - RNA, 21 nt, Artificial Sequence
  Description of Artificial Sequence: Synthetic oligonucleotide
aagcaagauauuuuuauaaua

SEQ ID NO: 2878 - RNA, 21 nt, Artificial Sequence
  Description of Artificial Sequence: Synthetic oligonucleotide
aagcaagauauuuuuauaaua

SEQ ID NO: 2879 - RNA, 21 nt, Artificial Sequence
  Description of Artificial Sequence: Synthetic oligonucleotide
aagcaagauauuuuuauaaua

SEQ ID NO: 2880 - DNA, 21 bp, Artificial Sequence
  Description of Artificial Sequence: Synthetic oligonucleotide
  Description of Combined DNA/RNA Molecule: Synthetic oligonucleotide
aagcaagauauuuuuataaua

SEQ ID NO: 2881 - DNA, 21 bp, Artificial Sequence
  Description of Artificial Sequence: Synthetic oligonucleotide
  Description of Combined DNA/RNA Molecule: Synthetic oligonucleotide
aagcaagauauuuuuataaua

SEQ ID NO: 2882 - DNA, 21 bp, Artificial Sequence
  Description of Artificial Sequence: Synthetic oligonucleotide
  Description of Combined DNA/RNA Molecule: Synthetic oligonucleotide
aagcaagauauuuuuataaua

SEQ ID NO: 2883 - RNA, 21 nt, Artificial Sequence
  Description of Artificial Sequence: Synthetic oligonucleotide
aagcaagauauuuuuauaaua

SEQ ID NO: 2884 - RNA, 21 nt, Artificial Sequence
  Description of Artificial Sequence: Synthetic oligonucleotide
aagcaagauauuuuuauaaua

SEQ ID NO: 2885 - RNA, 21 nt, Artificial Sequence
  Description of Artificial Sequence: Synthetic oligonucleotide
aagcaagauauuuuuauaaua

SEQ ID NO: 2886 - RNA, 23 nt, Artificial Sequence
  Description of Artificial Sequence: Synthetic oligonucleotide
uauuauaaaaauaucuugcuuuu

SEQ ID NO: 2887 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2888 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2889 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2890 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2891 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2892 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2893 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2894 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2895 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2896 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2897 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2898 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

SEQ ID NO: 2899 - DNA, 25 bp, Artificial Sequence
  Description of Artificial Sequence: Synthetic oligonucleotide
  Description of Combined DNA/RNA Molecule: Synthetic oligonucleotide
uauuauaaaaauaucuugcuuuutt

We claim:

1. A double-stranded ribonucleic acid (dsRNA) agent for inhibiting expression of complement component C5, wherein said dsRNA agent comprises a sense strand and an antisense strand, the antisense strand comprising a region of complementarity which comprises at least 17 contiguous nucleotides differing by no more than 3 nucleotides from the nucleotide sequence of 5'-UAUUAUAAAAAUAUCUUGCUUUU-3' (SEQ ID NO:113), and wherein said dsRNA agent comprises at least one modified nucleotide.

2. A double-stranded ribonucleic acid (dsRNA) agent for inhibiting expression of complement component C5, wherein said dsRNA agent comprises a sense strand and an antisense strand, the antisense strand comprising a region of complementarity which comprises at least 17 contiguous nucleotides differing by no more than 3 nucleotides from the nucleotide sequence of 5'-UAUUAUAAAAAUAUCUUGCUUUU-3' (SEQ ID NO:113),
wherein substantially all of the nucleotides of said sense strand and substantially all of the nucleotides of said antisense strand are modified nucleotides, and
wherein said sense strand is conjugated to a ligand attached at the 3'-terminus.

3. The dsRNA agent of claim 2, wherein all of the nucleotides of said sense strand and all of the nucleotides of said antisense strand are modified nucleotides.

4. The dsRNA agent of claim 2, wherein the modified nucleotide is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an abasic nucleotide, a 2'-amino-modified nucleotide, a 2'-alkyl-modified nucleotide, a morpholino nucleotide, a phosphoramidate, a non-natural base comprising nucleotide, a nucleotide comprising a 5'-phosphorothioate group, and a terminal nucleotide linked to a cholesteryl derivative or a dodecanoic acid bisdecylamide group.

5. The dsRNA agent of claim 4, wherein the modified nucleotide is a 2'-O-methyl nucleotide or a 2'-fluoro nucleotide.

6. The dsRNA agent of claim 1, wherein the region of complementarity is between 19 and 23 nucleotides in length.

7. The dsRNA agent of claim 1, wherein each strand is no more than 30 nucleotides in length.

8. The dsRNA agent of claim 1, wherein at least one strand comprises a 3' overhang of at least 2 nucleotides.

9. The dsRNA agent of claim 1, wherein said agent further comprises at least one phosphorothioate or methylphosphonate internucleotide linkage.

10. The dsRNA agent of claim 1, further comprising a ligand.

11. The dsRNA agent of claim 10, wherein the ligand is conjugated to the 3' end of the sense strand of the agent.

12. The dsRNA agent of claim 11, wherein the ligand is an N-acetylgalactosamine (GalNAc) derivative.

13. The dsRNA agent of claim 12, wherein the ligand is

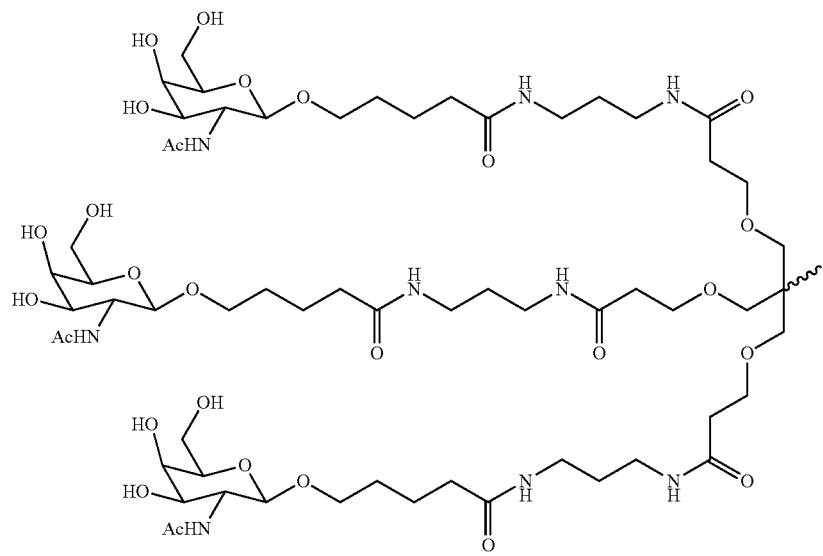 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

14. The dsRNA agent of claim 13, wherein the agent is conjugated to the ligand as shown in the following schematic

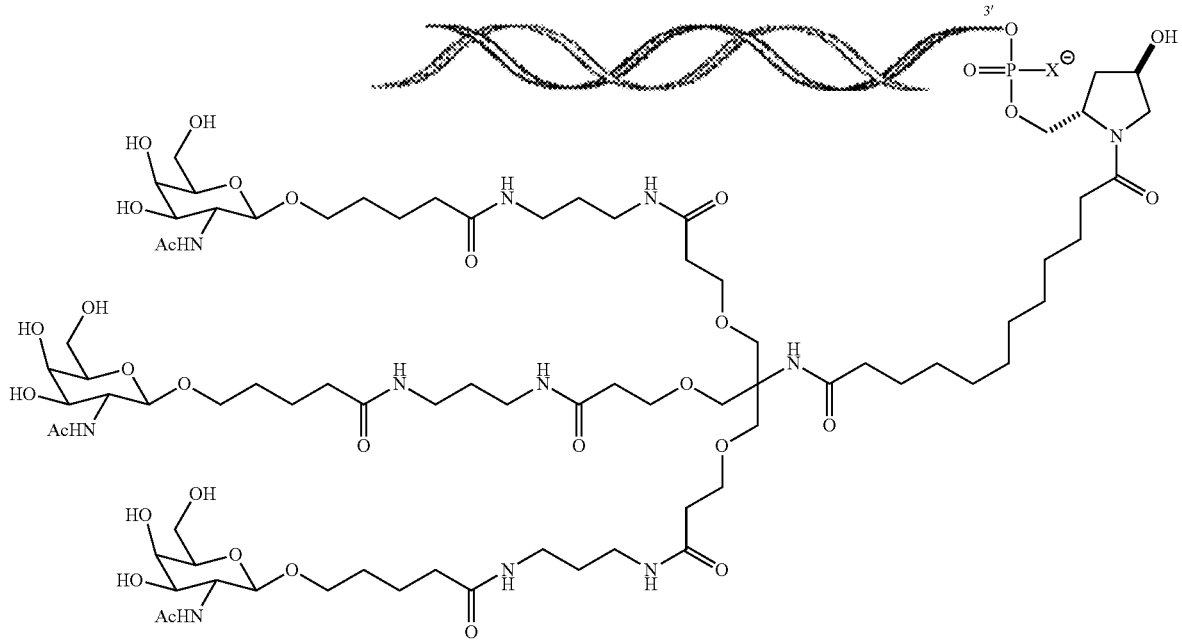

and, wherein X is O or S.

15. The dsRNA agent of claim 14, wherein the X is O.

16. The dsRNA agent of claim 1, wherein the region of complementarity consists of the nucleotide sequence of 5'-UAUUAUAAAAAUAUCUUGCUUUU-3' (SEQ ID NO:113).

17. The dsRNA agent of claim 1, wherein the agent comprises a sense strand comprising the nucleotide sequence of 5'-AAGCAAGAUAUUUUUAUAAUA-3' (SEQ ID NO:62), and an antisense strand comprising the nucleotide sequence of 5'-UAUUAUAAAAAUAUCUUGCUUUU-3' (SEQ ID NO:113).

18. The dsRNA agent of claim 17, wherein the sense strand comprises 5'-asasGfcAfaGfaUfAfUfuUfuuAfuAfaua-3' (SEQ ID NO:2876) and the antisense strand comprises 5'-usAfsUfuAfuaAfaAfauaUfcUfuGfcuususudTdT-3' (SEQ ID NO:2889), wherein a, g, c and u are 2'-O-methyl (2'-OMe) A, G, C, and U, respectively; Af, Gf, Cf and Uf are 2'-fluoro A, G, C and U, respectively; dT is a deoxy-thymine nucleotide; and s is a phosphorothioate linkage.

19. A double-stranded ribonucleic acid (dsRNA) agent for inhibiting expression of complement component C5, wherein said dsRNA agent comprises a sense strand and an antisense strand, wherein the sense strand comprises 5'-asasGfcAfaG-faUfAfUfuUfuuAfuAfaua-3' (SEQ ID NO:2876) and the antisense strand comprises 5'-usAfsUfuAfuaAfaAfauaUf-cUfuGfcuususudTdT-3' (SEQ ID NO:2889), wherein a, g, c and u are 2'-O-methyl (2'-OMe) A, G, C, and U, respectively; Af, Gf, Cf and Uf are 2'-fluoro A, G, C and U, respectively; dT is a deoxy-thymine nucleotide; and s is a phosphorothioate linkage; and wherein said sense strand is conjugated at the 3'-terminus to the ligand

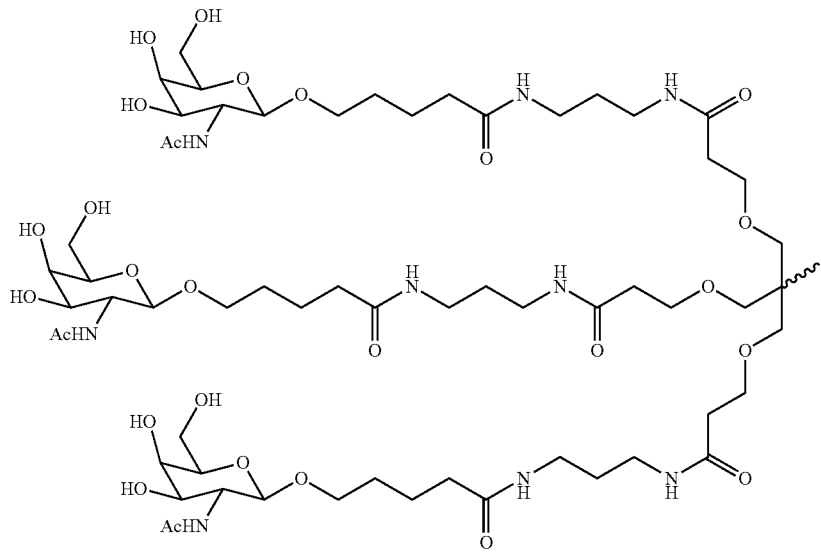

20. A cell comprising the dsRNA agent of claim 19.

21. A pharmaceutical composition for inhibiting expression of a complement component C5 gene comprising the dsRNA agent of claim 19.

22. A method of inhibiting complement component C5 expression in a cell, the method comprising:
  (a) contacting the cell with the dsRNA agent of claim 19; and
  (b) maintaining the cell produced in step (a) for a time sufficient to obtain degradation of the mRNA transcript of a complement component C5 gene, thereby inhibiting expression of the complement component C5 gene in the cell.

23. The method of claim 22, wherein said cell is within a subject.

24. The method of claim 22, wherein the subject is a human.

25. A method of treating a subject having a disease or disorder that would benefit from a reduction in complement component C5 expression, the method comprising administering to the subject a therapeutically effective amount of the dsRNA agent of claim 19, thereby treating said subject.

26. The method of claim 25, wherein the disorder is a complement component C5-associated disease.

27. A method of preventing at least one symptom in a subject having or prone to having a disease or disorder that would benefit from a reduction in complement component C5 expression, the method comprising administering to the subject a prophylactically effective amount of the dsRNA agent of claim 19, thereby preventing at least one symptom in the subject having or prone to having a disorder that would benefit from a reduction in C5 expression.

28. The method of claim 22, further comprising contacting the cell with an anti-complement component C5 antibody, or antigen-binding fragment thereof.

29. The method of claim 25, further comprising administering to the subject an anti-complement component C5 antibody, or antigen-binding fragment thereof.

30. The method of claim 27, further comprising administering to the subject an anti-complement component C5 antibody, or antigen-binding fragment thereof.

* * * * *